(12) United States Patent
Xiao et al.

(10) Patent No.: US 10,059,766 B2
(45) Date of Patent: Aug. 28, 2018

(54) ANTIBODY CONSTRUCTS FOR CDH19 AND CD3

(71) Applicants: AMGEN RESEARCH (MUNICH) GMBH, Munich (DE); AMGEN INC., Thousand Oaks, CA (US)

(72) Inventors: Shouhua Xiao, Foster City, CA (US); Zheng Pan, Fremont, CA (US); Dineli Wickramasinghe, San Francisco, CA (US); M. Shawn Jeffries, Indianapolis, IN (US); Chadwick Terence King, North Vancouver (CA); Brian Mingtung Chan, Port Coquitlam (CA); Peter Kufer, Munich (DE); Ralf Lutterbüse, Munich (DE); Tobias Raum, Munich (DE); Patrick Hoffmann, Munich (DE); Doris Rau, Munich (DE); Roman Kischel, Munich (DE); Bryan Lemon, Mountain View, CA (US); Holger Wesche, San Francisco, CA (US)

(73) Assignees: AMGEN INC., Thousand Oaks, CA (US); AMGEN RESEARCH (MUNICH) GMBH, Munich (DE)

( * ) Notice: Subject to any disclaimer, the term of this patent is extended or adjusted under 35 U.S.C. 154(b) by 0 days.

(21) Appl. No.: 14/761,839

(22) PCT Filed: Jan. 27, 2014

(86) PCT No.: PCT/EP2014/051550
§ 371 (c)(1),
(2) Date: Jul. 17, 2015

(87) PCT Pub. No.: WO2014/114800
PCT Pub. Date: Jul. 31, 2014

(65) Prior Publication Data
US 2015/0368343 A1 Dec. 24, 2015

Related U.S. Application Data

(60) Provisional application No. 61/756,991, filed on Jan. 25, 2013, provisional application No. 61/785,147, filed on Mar. 14, 2013.

(51) Int. Cl.
*C07K 16/28* (2006.01)
*C07K 16/30* (2006.01)
*C07K 16/46* (2006.01)
*A61K 47/60* (2017.01)
*A61K 39/00* (2006.01)

(52) U.S. Cl.
CPC .......... *C07K 16/2809* (2013.01); *A61K 47/60* (2017.08); *C07K 16/28* (2013.01); *C07K 16/2896* (2013.01); *C07K 16/3053* (2013.01); *C07K 16/468* (2013.01); *A61K 2039/505* (2013.01); *C07K 2317/21* (2013.01); *C07K 2317/31* (2013.01); *C07K 2317/33* (2013.01); *C07K 2317/565* (2013.01); *C07K 2317/569* (2013.01); *C07K 2317/622* (2013.01); *C07K 2317/626* (2013.01); *C07K 2317/73* (2013.01); *C07K 2317/77* (2013.01); *C07K 2317/92* (2013.01); *C07K 2319/00* (2013.01)

(58) Field of Classification Search
CPC .. C07K 16/28; C07K 16/2896; C07K 16/468; C07K 16/2809; C07K 2317/31; C07K 2317/33; C07K 2317/565; A61K 2039/505
USPC ...... 424/173.1; 435/252.3, 320.1, 334, 69.6; 530/387.3, 389.6; 536/25.53
See application file for complete search history.

(56) References Cited

U.S. PATENT DOCUMENTS

2014/0322218 A1* 10/2014 Xiao .................. C07K 16/28
424/135.1
2015/0322151 A1* 11/2015 Xiao .................. C07K 16/28
424/139.1

FOREIGN PATENT DOCUMENTS

| EP | 2258874 B1 | | 3/2015 |
|---|---|---|---|
| JP | 2008-521411 A | | 6/2008 |
| JP | 2010-524851 A | | 7/2010 |
| TW | I323734 B | | 4/2010 |
| WO | WO 2004/003019 | * | 6/2004 |
| WO | WO-2006/071441 A2 | | 7/2006 |
| WO | WO-2007/024715 A2 | | 3/2007 |
| WO | WO-2008/119567 A2 | | 10/2008 |

OTHER PUBLICATIONS

Ward et al. (Nature 341:544-546 (1989)).*
Smith-Gill et al. (J. Immunol. 139:4135-4144 (1987)).*
Kumar et al. (J. Biol. Chem. 275:35129-35136 (2000)).*
Song et al. (Biochem Biophys Res Comm 268:390-394 (2000)).*
Anti-CDH19 Product Datasheet, <<https://atlasantibodies.com/print_datasheet/R74953>> retrieved May 13, 2014.
Bertucci et al., Gene expression profiling of human melanoma cell lines with distinct metastatic potential identifies new progression markers. *Int. J. Cancer Res. Treatment* 27(5A): 3441-9 (2007).

(Continued)

*Primary Examiner* — Lynn A Bristol
(74) *Attorney, Agent, or Firm* — Marshall, Gerstein & Borun LLP

(57) ABSTRACT

The invention provides a bispecific antibody construct comprising a first human binding domain capable of binding to human CDH19 on the surface of a target cell and a second domain capable of binding to human CD3 on the surface of a T cell. Moreover, the invention provides a nucleic acid encoding the antibody construct, a vector comprising the nucleic acid and a host cell transformed or transfected with the vector. Furthermore, the invention provides a process for the production of the bispecific antibody construct, a medical use of the antibody construct and a kit comprising the antibody construct. The bispecific antibody construct may be useful in the treatment of melanoma.

17 Claims, 46 Drawing Sheets

Specification includes a Sequence Listing.

(56) References Cited

OTHER PUBLICATIONS

CDH19 monoclonal antibody (M01), clone 1G4, <<http://www.abnova.com/protocol_pdf/DS_H00028513-M01.pdf>> retrieved May 13, 2014.

Kischel et al., Characterization of novel CD33-and MCSP-specific BiTE antibodies for the treatment of acute myeloid leukemia and melanoma, receptively, that are fully human in sequence. *Am. Assoc. Cancer Res.* 49: 567-8 (2008).

Niu et a., Monocyte chemotactic protein (MCP)-1 promotes angiogenesis via a novel transcription factor, MCP-1 induced protein (MCPIP). *J. Biol. Chem.* 283(21): 14542-51 (2008).

\* cited by examiner

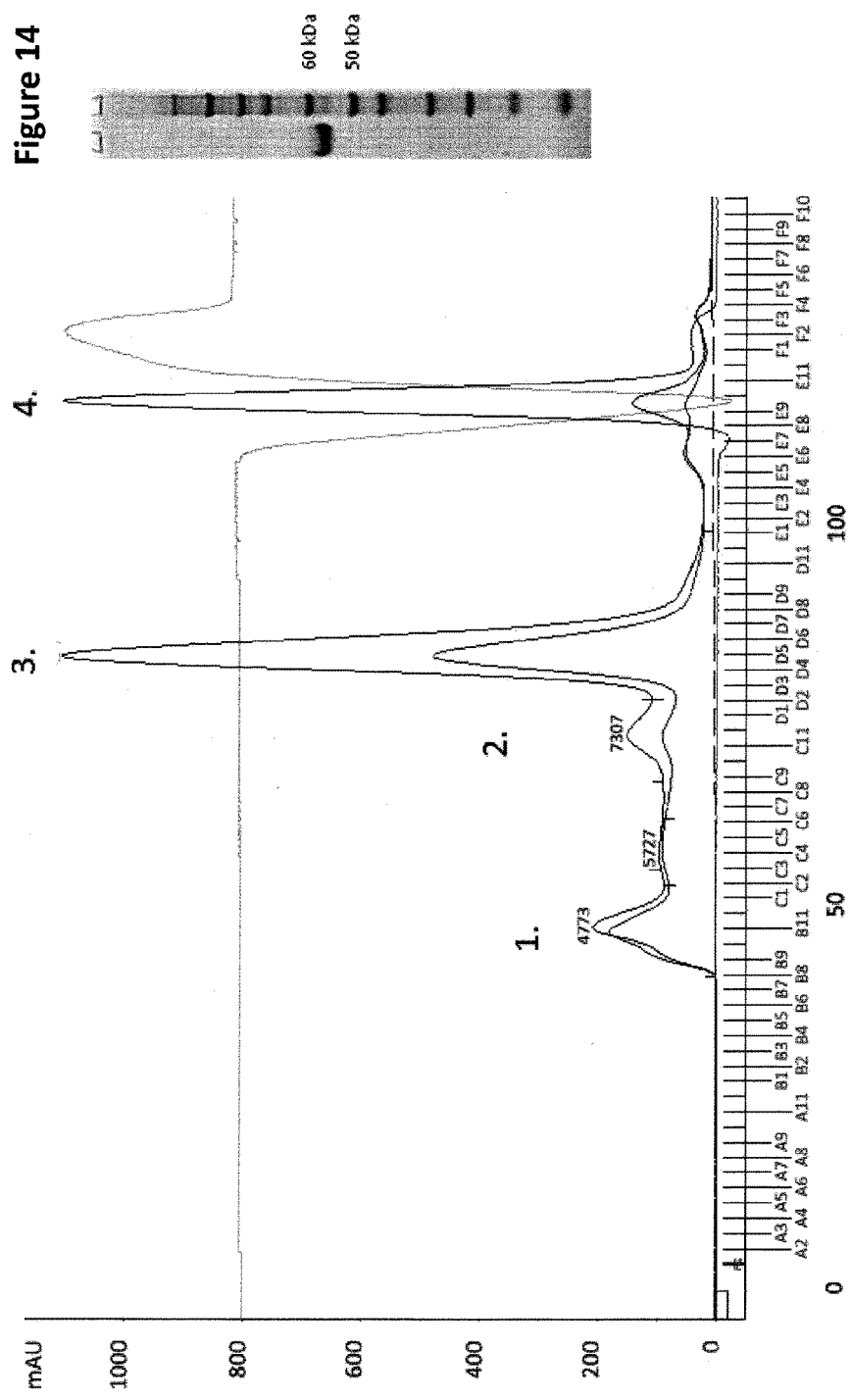

ANTIBODY CONSTRUCTS FOR CDH19 AND CD3

RELATED APPLICATIONS

This application is related to a U.S. provisional application entitled "Antibodies targeting CDH19 for melanoma", filed on Mar. 15, 2013, the same day as the present application is filed. This related application is incorporated in its entirety by reference.

FIELD OF THE INVENTION

The present invention relates to an antibody construct comprising a first human binding domain capable of binding to human CDH19 on the surface of a target cell and a second domain capable of binding to human CD3 on the surface of a T cell. Moreover, the invention provides a nucleic acid sequence encoding the antibody construct, a vector comprising said nucleic acid sequence and a host cell transformed or transfected with said vector. Furthermore, the invention provides a process for the production of the antibody construct of the invention, a medical use of said antibody construct and a kit comprising said antibody construct.

BACKGROUND OF THE INVENTION

Melanoma is a skin cancer that is caused by the oncogenic transformation of melanocytes, which are pigment producing skin cells. As of 2009, Melanoma had a prevalence of more than 870,000 cases in the US alone (US National Institutes of Health). Each year, over 75,000 new cases of melanoma are diagnosed in the US, and approximately 25% of patients have advanced disease at the time of diagnosis. Despite the fact that cases of primary melanoma can be cured by surgery if they are detected early enough, melanoma is the leading cause of death from skin disease in the US, responsible for about 10,000 deaths per year in the US. Once the disease has spread and became metastatic, the prognosis is poor, with a 5 year relative survival of 15%.

There are four basic types of melanomas. Three types are found in the top layers of the skin and the fourth one is invasive and has penetrated deeper into the skin and may have spread to other areas of the body.

Superficial spreading melanoma is the most common type of melanoma which accounts for about 70% of all cases. It grows along the top layer of the skin for a fairly long time before penetrating more deeply. It first appears as a flat or slightly raised discolored patch that has irregular borders and may be somewhat asymmetrical in form. The color varies, and you may see areas of tan, brown, black, red, blue or white. This type of melanoma can occur in a previously benign mole and is found most often in young people.

Lentigo maligna is similar to the superficial spreading type, as it also remains close to the skin surface for quite a while, and usually appears as a flat or mildly elevated mottled tan, brown or dark brown discoloration. It is found most often in the elderly. When this cancer becomes invasive, it is referred to as lentigo maligna melanoma.

Acral lentiginous melanoma also spreads superficially before penetrating more deeply. It is quite different from the others, though, as it usually appears as a black or brown discoloration under the nails or on the soles of the feet or palms of the hands. This type of melanoma is sometimes found on dark-skinned people, and can often advance more quickly than superficial spreading melanoma and lentigo maligna.

Nodular melanoma is usually invasive at the time it is first diagnosed. The malignancy is recognized when it becomes a bump. It is usually black, but occasionally is blue, gray, white, brown, tan, red or skin tone. This is the most aggressive of the melanomas, and is found in 10 to 15 percent of cases.

Common treatments for metastatic melanoma include chemotherapy, targeted therapies for eligible patients (e.g. BRAF inhibitor treatment for patients with BRAF mutations) and immunotherapy. Metastatic melanoma is a tumor type where immunotherapy has been demonstrated to not only slow disease progression, but to lead to cures in late stage patients. Interleukin-2 was approved for the use in metastatic melanoma in 1998, and in 2011 an antibody targeting CTLA4, a member of a new generation of immune checkpoint inhibitors, gained approval by the FDA.

CDH19 is a type II cadherin transmembrane protein of unknown function. The human gene was cloned in 2000 based on its sequence similarity to CDH7 (Kools, P. et al. Genomics. 2000). Expressed Sequence Tags (ESTs) for CDH19 were isolated from melanocyte cDNA libraries, indicating that expression of CDH19 may be limited to cells of neural crest origin (Kools, P. et al. Genomics. 2000). In support of this notion, rat CDH19 was found to be expressed primarily in nerve ganglia and in Schwann cells during rat embryonic development (Takahashi, M. and Osumi, O. Devl Dynamics. 2005.).

Diagnostic antibodies detecting CDH19 in Western Blot, immunohistochemistry or flow cytometry are known in the art and commercially available. Those antibodies comprise poly- and monoclonal antibodies generated in animal hosts.

SUMMARY OF THE INVENTION

The present invention provides an isolated multispecific antibody construct comprising a first human binding domain capable of binding to human CDH19 on the surface of a target cell and a second domain capable of binding to human CD3 on the surface of a T cell.

In one embodiment the antibody construct of the invention the first binding domain comprises a VH region comprising CDR-H1, CDR-H2 and CDR-H3 and a VL region comprising CDR-L1, CDR-L2 and CDR-L3 selected from the group consisting of:

(a) CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 222, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 252, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 82, CDR-H2 as depicted in SEQ ID NO: 83, CDR-H3 as depicted in SEQ ID NO: 909, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 926, CDR-H1 as depicted in SEQ ID NO: 52, CDR-H2 as depicted in SEQ ID NO: 53, CDR-H3 as depicted in SEQ ID NO: 904, CDR-L1 as depicted in SEQ ID NO: 220, CDR-L2 as depicted in SEQ ID NO: 221 and CDR-L3 as depicted in SEQ ID NO: 926, CDR-H1 as depicted in SEQ ID NO: 1126, CDR-H2 as depicted in SEQ ID NO: 1127, CDR-H3 as depicted in SEQ ID NO: 1128, CDR-L1 as depicted in SEQ ID NO: 1129, CDR-L2 as depicted in SEQ ID NO: 1130 and CDR-L3 as depicted in SEQ ID NO: 1131, CDR-H1 as depicted in SEQ ID NO: 1165, CDR-H2 as depicted in SEQ ID NO: 1166, CDR-H3 as depicted in SEQ ID NO: 1167, CDR-L1 as depicted in SEQ ID NO: 1168, CDR-L2 as depicted in SEQ ID NO: 1169 and CDR-L3 as depicted in SEQ ID NO: 1170, CDR-H1 as depicted in SEQ ID NO: 1334, CDR-H2 as depicted in SEQ ID NO: 1335, CDR-H3 as depicted in SEQ ID NO: 1336, CDR-L1 as depicted in SEQ ID NO: 1337, CDR-L2 as depicted in SEQ ID NO: 1338 and CDR-L3 as depicted in SEQ ID NO: 1339, CDR-H1 as depicted in SEQ ID NO: 1347, CDR-H2 as depicted in SEQ ID NO: 1348, CDR-H3 as depicted in SEQ ID NO: 1349, CDR-L1 as depicted in SEQ ID NO: 1350, CDR-L2 as depicted in SEQ ID NO: 1351 and CDR-L3 as depicted in SEQ ID NO: 1352, CDR-H1 as depicted in SEQ ID NO: 1360 CDR-H2 as depicted in SEQ ID NO: 1361, CDR-H3 as depicted in SEQ ID NO: 1362, CDR-L1 as depicted in SEQ ID NO: 1363, CDR-L2 as depicted in SEQ ID NO: 1364 and CDR-L3 as depicted in SEQ ID NO: 1365, CDR-H1 as depicted in SEQ ID NO: 1425 CDR-H2 as depicted in SEQ ID NO: 1426, CDR-H3 as depicted in SEQ ID NO: 1427, CDR-L1 as depicted in SEQ ID NO: 1428, CDR-L2 as depicted in SEQ ID NO: 1429 and CDR-L3 as depicted in SEQ ID NO: 1430, CDR-H1 as depicted in SEQ ID NO: 1438 CDR-H2 as depicted in SEQ ID NO: 1439, CDR-H3 as depicted in SEQ ID NO: 1440, CDR-L1 as depicted in SEQ ID NO: 1441, CDR-L2 as depicted in SEQ ID NO: 1442 and CDR-L3 as depicted in SEQ ID NO: 1443, and CDR-H1 as depicted in SEQ ID NO: 2167 CDR-H2 as depicted in SEQ ID NO: 2168, CDR-H3 as depicted in SEQ ID NO: 2169, CDR-L1 as depicted in SEQ ID NO: 2170, CDR-L2 as depicted in SEQ ID NO: 2171 and CDR-L3 as depicted in SEQ ID NO: 2172;

(b) CDR-H1 as depicted in SEQ ID NO: 124, CDR-H2 as depicted in SEQ ID NO: 125, CDR-H3 as depicted in SEQ ID NO: 126, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 300, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 306, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 312, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 928, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 929, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 942, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 943, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 937, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 148, CDR-H2 as depicted in SEQ ID NO: 149, CDR-H3 as depicted in SEQ ID NO: 919, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 936, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 933, CDR-H1 as depicted in SEQ ID NO: 136, CDR-H2 as depicted in SEQ ID NO: 137, CDR-H3 as depicted in SEQ ID NO: 917, CDR-L1 as depicted in SEQ ID NO: 304, CDR-L2 as depicted in SEQ ID NO: 305 and CDR-L3 as depicted in SEQ ID NO: 934, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 930, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 931, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 932, CDR-H1 as depicted in SEQ ID NO: 1009, CDR-H2 as depicted in SEQ ID NO: 1010, CDR-H3 as depicted in SEQ ID NO: 1011, CDR-L1 as depicted in SEQ ID NO: 1012, CDR-L2 as depicted in SEQ ID NO: 1013 and CDR-L3 as depicted in SEQ ID NO: 1014, CDR-H1 as depicted in SEQ ID NO: 1022, CDR-H2 as depicted in SEQ ID NO: 1023, CDR-H3 as depicted in SEQ ID NO: 1024, CDR-L1 as depicted in SEQ ID NO: 1025, CDR-L2 as depicted in SEQ ID NO: 1026 and CDR-L3 as depicted in SEQ ID NO: 1027, CDR-H1 as depicted in SEQ ID NO: 1035, CDR-H2 as depicted in SEQ ID NO: 1036, CDR-H3 as depicted in SEQ ID NO: 1037, CDR-L1 as depicted in SEQ ID NO: 1038, CDR-L2 as depicted in SEQ ID NO: 1039 and CDR-L3 as depicted in SEQ ID NO: 1040, CDR-H1 as depicted in SEQ ID NO: 1074, CDR-H2 as depicted in SEQ ID NO: 1075, CDR-H3 as depicted in SEQ ID NO: 1076, CDR-L1 as depicted in SEQ ID NO: 1077, CDR-L2 as depicted in SEQ ID NO: 1078 and CDR-L3 as depicted in SEQ ID NO 1079, CDR-H1 as depicted in SEQ ID NO: 1100, CDR-H2 as depicted in SEQ ID NO: 1101, CDR-H3 as depicted in SEQ ID NO: 1102, CDR-L1 as depicted in SEQ ID NO: 1103, CDR-L2 as depicted in SEQ ID NO: 1104 and CDR-L3 as depicted in SEQ ID NO: 1105, CDR-H1 as depicted in SEQ ID NO: 1113, CDR-H2 as depicted in SEQ ID NO: 1114, CDR-H3 as depicted in SEQ ID NO: 1115, CDR-L1 as depicted in SEQ ID NO: 1116, CDR-L2 as depicted in SEQ ID NO: 1117 and CDR-L3 as depicted in SEQ ID NO: 1118, CDR-H1 as depicted in SEQ ID NO: 1243, CDR-H2 as depicted in SEQ ID NO: 1244, CDR-H3 as depicted in SEQ ID NO: 1245, CDR-L1 as depicted in SEQ ID NO: 1246, CDR-L2 as depicted in SEQ ID NO: 1247 and CDR-L3 as depicted in SEQ ID NO: 1248, CDR-H1 as depicted in SEQ ID NO: 1256, CDR-H2 as depicted in SEQ ID NO: 1257, CDR-H3 as depicted in SEQ ID NO: 1258, CDR-L1 as depicted in SEQ ID NO: 1259, CDR-L2 as depicted in SEQ ID NO: 1260 and CDR-L3 as depicted in SEQ ID NO: 1261, CDR-H1 as depicted in SEQ ID NO: 1269, CDR-H2 as depicted in SEQ ID NO: 1270, CDR-H3 as depicted in SEQ ID NO: 1271, CDR-L1 as depicted in SEQ ID NO: 1272, CDR-L2 as depicted in SEQ ID NO: 1273 and CDR-L3 as depicted in SEQ ID NO: 1274, CDR-H1 as depicted in SEQ ID NO: 1282, CDR-H2 as depicted in SEQ ID NO: 1283, CDR-H3 as depicted in SEQ ID NO: 1284, CDR-L1 as depicted in SEQ ID NO: 1285, CDR-L2 as depicted in SEQ ID NO: 1286 and CDR-L3 as depicted in SEQ ID NO: 1287, CDR-H1 as depicted in SEQ ID NO: 1295, CDR-H2 as depicted in SEQ ID NO: 1296, CDR-H3 as depicted in SEQ ID NO: 1297, CDR-L1 as depicted in SEQ ID NO: 1298, CDR-L2 as depicted in SEQ ID NO: 1299 and CDR-L3 as depicted in SEQ ID NO: 1300, CDR-H1 as depicted in SEQ ID NO: 1647, CDR-H2 as depicted in SEQ ID NO: 1648, CDR-H3 as depicted in SEQ ID NO: 1649, CDR-L1 as depicted in SEQ ID NO: 1650, CDR-L2 as depicted in SEQ ID NO: 1651 and CDR-L3 as depicted in SEQ ID NO: 1652, CDR-H1 as depicted in SEQ ID NO: 1660, CDR-H2 as depicted in SEQ ID NO: 1661, CDR-H3 as depicted in SEQ ID NO: 1662, CDR-L1 as depicted in SEQ ID NO: 1663, CDR-L2 as depicted in SEQ ID NO: 1664 and CDR-L3 as depicted in SEQ ID NO: 1665, CDR-H1 as depicted in SEQ ID NO: 1894, CDR-H2 as depicted in SEQ ID NO: 1895, CDR-H3 as depicted in SEQ ID NO: 1896, CDR-L1 as depicted in SEQ ID NO: 1897, CDR-L2 as depicted in SEQ ID NO: 1898 and CDR-L3 as depicted in SEQ ID NO: 1899, CDR-H1 as depicted in SEQ ID NO: 1907, CDR-H2 as depicted in SEQ ID NO: 1908, CDR-H3 as depicted in SEQ ID NO: 1909, CDR-L1 as depicted in SEQ ID NO: 1910, CDR-L2 as depicted in SEQ ID NO: 1911 and CDR-L3 as depicted in SEQ ID NO: 1912, CDR-H1 as depicted in SEQ ID NO: 1933, CDR-H2 as depicted in SEQ ID NO: 1934, CDR-H3 as depicted in SEQ ID NO: 1935, CDR-L1 as depicted in SEQ ID NO: 1936, CDR-L2 as depicted in SEQ ID NO: 1937 and CDR-L3 as depicted in SEQ ID NO: 1938, CDR-H1 as depicted in SEQ ID NO: 1946, CDR-H2 as depicted in SEQ ID NO: 1947, CDR-H3 as depicted in SEQ ID NO: 1948, CDR-L1 as depicted in SEQ ID NO: 1949, CDR-L2 as depicted in SEQ ID NO: 1950 and CDR-L3 as depicted in SEQ ID NO: 1951, CDR-H1 as depicted in SEQ ID NO: 1959, CDR-H2 as depicted in SEQ ID NO: 1960, CDR-H3 as depicted in SEQ ID NO: 1961, CDR-L1 as depicted in SEQ ID NO: 1962, CDR-L2 as depicted in SEQ ID NO: 1963 and CDR-L3 as depicted in SEQ ID NO: 1964, CDR-H1 as depicted in SEQ ID NO: 1972, CDR-H2 as depicted in SEQ ID NO: 1973, CDR-H3 as depicted in SEQ ID NO: 1974, CDR-L1 as depicted in SEQ ID NO: 1975, CDR-L2 as depicted in SEQ ID NO: 1976 and CDR-L3 as depicted in SEQ ID NO: 1977, CDR-H1 as depicted in SEQ ID NO: 1985, CDR-H2 as depicted in SEQ ID NO: 1986, CDR-H3 as depicted in SEQ ID NO: 1987, CDR-L1 as depicted in SEQ ID NO: 1988, CDR-L2 as depicted in SEQ ID NO: 1989 and CDR-L3 as depicted in SEQ ID NO: 1990, CDR-H1 as depicted in SEQ ID NO: 1998, CDR-H2 as depicted in SEQ ID NO: 1999, CDR-H3 as depicted in SEQ ID NO: 2000, CDR-L1 as depicted in SEQ ID NO: 2001, CDR-L2 as depicted in SEQ ID NO: 2002 and CDR-L3 as depicted in SEQ ID NO: 2003, CDR-H1 as depicted in SEQ ID NO: 2011, CDR-H2 as depicted in SEQ ID NO: 2012, CDR-H3 as depicted in SEQ ID NO: 2013, CDR-L1 as depicted in SEQ ID NO: 2014, CDR-L2 as depicted in SEQ ID NO: 2015 and CDR-L3 as depicted in SEQ ID NO: 2016, CDR-H1 as depicted in SEQ ID NO: 2024, CDR-H2 as depicted in SEQ ID NO: 2025, CDR-H3 as depicted in SEQ ID NO: 2026, CDR-L1 as depicted in SEQ ID NO: 2027, CDR-L2 as depicted in SEQ ID NO: 2028 and CDR-L3 as depicted in SEQ ID NO: 2029, CDR-H1 as depicted in SEQ ID NO: 2037, CDR-H2 as depicted in SEQ ID NO: 2038, CDR-H3 as depicted in SEQ ID NO: 2039, CDR-L1 as depicted in SEQ ID NO: 2040, CDR-L2 as depicted in SEQ ID NO: 2041 and CDR-L3 as depicted in SEQ ID NO: 2042, and CDR-H1 as depicted in SEQ ID NO: 2050, CDR-H2 as depicted in SEQ ID NO: 2051, CDR-H3 as depicted in SEQ ID NO: 2052, CDR-L1 as depicted in SEQ ID NO: 2053, CDR-L2 as depicted in SEQ ID NO: 2054 and CDR-L3 as depicted in SEQ ID NO: 2055;

(c) CDR-H1 as depicted in SEQ ID NO: 94, CDR-H2 as depicted in SEQ ID NO: 95, CDR-H3 as depicted in SEQ ID NO: 96, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 100, CDR-H2 as depicted in SEQ ID NO: 101, CDR-H3 as depicted in SEQ ID NO: 102, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 156, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 100, CDR-H2 as depicted in SEQ ID NO: 101, CDR-H3 as depicted in SEQ ID NO: 912, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 100, CDR-H2 as depicted in SEQ ID NO: 101, CDR-H3 as depicted in SEQ ID NO: 913, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 94, CDR-H2 as depicted in SEQ ID NO: 95, CDR-H3 as depicted in SEQ ID NO: 910, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 94, CDR-H2 as depicted in SEQ ID NO: 95, CDR-H3 as depicted in SEQ ID NO: 911, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 118, CDR-H2 as depicted in SEQ ID NO: 914, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 920, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 996, CDR-H2 as depicted in SEQ ID NO: 997, CDR-H3 as depicted in SEQ ID NO: 998, CDR-L1 as depicted in SEQ ID NO: 999, CDR-L2 as depicted in SEQ ID NO: 1000 and CDR-L3 as depicted in SEQ ID NO: 1001, CDR-H1 as depicted in SEQ ID NO: 1048, CDR-H2 as depicted in SEQ ID NO: 1049, CDR-H3 as depicted in SEQ ID NO: 1050, CDR-L1 as depicted in SEQ ID NO: 1051, CDR-L2 as depicted in SEQ ID NO: 1052 and CDR-L3 as depicted in SEQ ID NO: 1053, CDR-H1 as depicted in SEQ ID NO: 1087, CDR-H2 as depicted in SEQ ID NO: 1088, CDR-H3 as depicted in SEQ ID NO: 1089, CDR-L1 as depicted in SEQ ID NO: 1090, CDR-L2 as depicted in SEQ ID NO: 1091 and CDR-L3 as depicted in SEQ ID NO: 1092, CDR-H1 as depicted in SEQ ID NO: 1608, CDR-H2 as depicted in SEQ ID NO: 1609, CDR-H3 as depicted in SEQ ID NO: 1610, CDR-L1 as depicted in SEQ ID NO: 1611, CDR-L2 as depicted in SEQ ID NO: 1612 and CDR-L3 as depicted in SEQ ID NO: 1613, CDR-H1 as depicted in SEQ ID NO: 1621, CDR-H2 as depicted in SEQ ID NO: 1622, CDR-H3 as depicted in SEQ ID NO: 1623, CDR-L1 as depicted in SEQ ID NO: 1624, CDR-L2 as depicted in SEQ ID NO: 1625 and CDR-L3 as depicted in SEQ ID NO: 1626, CDR-H1 as depicted in SEQ ID NO: 1634, CDR-H2 as depicted in SEQ ID NO: 1635, CDR-H3 as depicted in SEQ ID NO: 1636, CDR-L1 as depicted in SEQ ID NO: 1637, CDR-L2 as depicted in SEQ ID NO: 1638 and CDR-L3 as depicted in SEQ ID NO: 1639, CDR-H1 as depicted in SEQ ID NO: 1673, CDR-H2 as depicted in SEQ ID NO: 1674, CDR-H3 as depicted in SEQ ID NO: 1675, CDR-L1 as depicted in SEQ ID NO: 1676, CDR-L2 as depicted in SEQ ID NO: 1677 and CDR-L3 as depicted in SEQ ID NO: 1678, CDR-H1 as depicted in SEQ ID NO: 1686, CDR-H2 as depicted in SEQ ID NO: 1687, CDR-H3 as depicted in SEQ ID NO: 1688, CDR-L1 as depicted in SEQ ID NO: 1689, CDR-L2 as depicted in SEQ ID NO: 1690 and CDR-L3 as depicted in SEQ ID NO: 1691, CDR-H1 as depicted in SEQ ID NO: 1699, CDR-H2 as depicted in SEQ ID NO: 1700, CDR-H3 as depicted in SEQ ID NO: 1701, CDR-L1 as depicted in SEQ ID NO: 1702, CDR-L2 as depicted in SEQ ID NO: 1703 and CDR-L3 as depicted in SEQ ID NO: 1704, CDR-H1 as depicted in SEQ ID NO: 1712, CDR-H2 as depicted in SEQ ID NO: 1713, CDR-H3 as depicted in SEQ ID NO: 1714, CDR-L1 as depicted in SEQ ID NO: 1715, CDR-L2 as depicted in SEQ ID NO: 1716 and CDR-L3 as depicted in SEQ ID NO: 1717, CDR-H1 as depicted in SEQ ID NO: 1725, CDR-H2 as depicted in SEQ ID NO: 1726, CDR-H3 as depicted in SEQ ID NO: 1727, CDR-L1 as depicted in SEQ ID NO: 1728, CDR-L2 as depicted in SEQ ID NO: 1729 and CDR-L3 as depicted in SEQ ID NO: 1730, CDR-H1 as depicted in SEQ ID NO: 1738, CDR-H2 as depicted in SEQ ID NO: 1739, CDR-H3 as depicted in SEQ ID NO: 1740, CDR-L1 as depicted in SEQ ID NO: 1741, CDR-L2 as depicted in SEQ ID NO: 1742 and CDR-L3 as depicted in SEQ ID NO: 1743, CDR-H1 as depicted in SEQ ID NO: 1751, CDR-H2 as depicted in SEQ ID NO: 1752, CDR-H3 as depicted in SEQ ID NO: 1753, CDR-L1 as depicted in SEQ ID NO: 1754, CDR-L2 as depicted in SEQ ID NO: 1755 and CDR-L3 as depicted in SEQ ID NO: 1756, CDR-H1 as depicted in SEQ ID NO: 1764, CDR-H2 as depicted in SEQ ID NO: 1765, CDR-H3 as depicted in SEQ ID NO: 1766, CDR-L1 as depicted in SEQ ID NO: 1767, CDR-L2 as depicted in SEQ ID NO: 1768 and CDR-L3 as depicted in SEQ ID NO: 1769, and CDR-H1 as depicted in SEQ ID NO: 1920, CDR-H2 as depicted in SEQ ID NO: 1921, CDR-H3 as depicted in SEQ ID NO: 1922, CDR-L1 as depicted in SEQ ID NO: 1923, CDR-L2 as depicted in SEQ ID NO: 1924 and CDR-L3 as depicted in SEQ ID NO: 1925;

(d) CDR-H1 as depicted in SEQ ID NO: 4, CDR-H2 as depicted in SEQ ID NO: 5, CDR-H3 as depicted in SEQ ID NO: 6, CDR-L1 as depicted in SEQ ID NO: 172, CDR-L2 as depicted in SEQ ID NO: 173 and CDR-L3 as depicted in SEQ ID NO: 174, CDR-H1 as depicted in SEQ ID NO: 10, CDR-H2 as depicted in SEQ ID NO: 11, CDR-H3 as depicted in SEQ ID NO: 12, CDR-L1 as depicted in SEQ ID NO: 178, CDR-L2 as depicted in SEQ ID NO: 179 and CDR-L3 as depicted in SEQ ID NO: 180, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 198, CDR-H1 as depicted in SEQ ID NO: 34, CDR-H2 as depicted in SEQ ID NO: 35, CDR-H3 as depicted in SEQ ID NO: 36, CDR-L1 as depicted in SEQ ID NO: 202, CDR-L2 as depicted in SEQ ID NO: 203 and CDR-L3 as depicted in SEQ ID NO: 204, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 214, CDR-L2 as depicted in SEQ ID NO: 215 and CDR-L3 as depicted in SEQ ID NO: 216, CDR-H1 as depicted in SEQ ID NO: 58, CDR-H2 as depicted in SEQ ID NO: 59, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 64, CDR-H2 as depicted in SEQ ID NO: 65, CDR-H3 as depicted in SEQ ID NO: 66, CDR-L1 as depicted in SEQ ID NO: 232, CDR-L2 as depicted in SEQ ID NO: 233 and CDR-L3 as depicted in SEQ ID NO: 234, CDR-H1 as depicted in SEQ ID NO: 70, CDR-H2 as depicted in SEQ ID NO: 71, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 328, CDR-L2 as depicted in SEQ ID NO: 329 and CDR-L3 as depicted in SEQ ID NO: 330, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 902, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 903, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 925, CDR-L2 as depicted in SEQ ID NO: 215 and CDR-L3 as depicted in SEQ ID NO: 216, CDR-H1 as depicted in SEQ ID NO: 70, CDR-H2 as depicted in SEQ ID NO: 907, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 70, CDR-H2 as depicted in SEQ ID NO: 907, CDR-H3 as depicted in SEQ ID NO: 908, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 58, CDR-H2 as depicted in SEQ ID NO: 905, CDR-H3 as depicted in SEQ ID NO: 906, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 58, CDR-H2 as depicted in SEQ ID NO: 905, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 160, CDR-H2 as depicted in SEQ ID NO: 921, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 940, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 941, CDR-L2 as depicted in SEQ ID NO: 329 and CDR-L3 as depicted in SEQ ID NO: 330, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 970, CDR-H2 as depicted in SEQ ID NO: 971, CDR-H3 as depicted in SEQ ID NO: 972, CDR-L1 as depicted in SEQ ID NO: 973, CDR-L2 as depicted in SEQ ID NO: 974 and CDR-L3 as depicted in SEQ ID NO: 975, CDR-H1 as depicted in SEQ ID NO: 1061, CDR-H2 as depicted in SEQ ID NO: 1062, CDR-H3 as depicted in SEQ ID NO: 1063, CDR-L1 as depicted in SEQ ID NO: 1064, CDR-L2 as depicted in SEQ ID NO: 1065 and CDR-L3 as depicted in SEQ ID NO 1066, CDR-H1 as depicted in SEQ ID NO: 1139, CDR-H2 as depicted in SEQ ID NO: 1140, CDR-H3 as depicted in SEQ ID NO: 1141, CDR-L1 as depicted in SEQ ID NO: 1142, CDR-L2 as depicted in SEQ ID NO: 1143 and CDR-L3 as depicted in SEQ ID NO: 1144, CDR-H1 as depicted in SEQ ID NO: 1152, CDR-H2 as depicted in SEQ ID NO: 1153, CDR-H3 as depicted in SEQ ID NO: 1154, CDR-L1 as depicted in SEQ ID NO: 1155, CDR-L2 as depicted in SEQ ID NO: 1156 and CDR-L3 as depicted in SEQ ID NO: 1157, CDR-H1 as depicted in SEQ ID NO: 1178, CDR-H2 as depicted in SEQ ID NO: 1179, CDR-H3 as depicted in SEQ ID NO: 1180, CDR-L1 as depicted in SEQ ID NO: 1181, CDR-L2 as depicted in SEQ ID NO: 1182 and CDR-L3 as depicted in SEQ ID NO: 1183, CDR-H1 as depicted in SEQ ID NO: 1191, CDR-H2 as depicted in SEQ ID NO: 1192, CDR-H3 as depicted in SEQ ID NO: 1193, CDR-L1 as depicted in SEQ ID NO: 1194, CDR-L2 as depicted in SEQ ID NO: 1195 and CDR-L3 as depicted in SEQ ID NO: 1196, CDR-H1 as depicted in SEQ ID NO: 1204, CDR-H2 as depicted in SEQ ID NO: 1205, CDR-H3 as depicted in SEQ ID NO: 1206, CDR-L1 as depicted in SEQ ID NO: 1207, CDR-L2 as depicted in SEQ ID NO: 1208 and CDR-L3 as depicted in SEQ ID NO: 1209, CDR-H1 as depicted in SEQ ID NO: 1217, CDR-H2 as depicted in SEQ ID NO: 1218, CDR-H3 as depicted in SEQ ID NO: 1219, CDR-L1 as depicted in SEQ ID NO: 1220, CDR-L2 as depicted in SEQ ID NO: 1221 and CDR-L3 as depicted in SEQ ID NO: 1222, CDR-H1 as depicted in SEQ ID NO: 1230, CDR-H2 as depicted in SEQ ID NO: 1231, CDR-H3 as depicted in SEQ ID NO: 1232, CDR-L1 as depicted in SEQ ID NO: 1233, CDR-L2 as depicted in SEQ ID NO: 1234 and CDR-L3 as depicted in SEQ ID NO: 1235, CDR-H1 as depicted in SEQ ID NO: 1308, CDR-H2 as depicted in SEQ ID NO: 1309, CDR-H3 as depicted in SEQ ID NO: 1310, CDR-L1 as depicted in SEQ ID NO: 1311, CDR-L2 as depicted in SEQ ID NO: 1312 and CDR-L3 as depicted in SEQ ID NO: 1313, CDR-H1 as depicted in SEQ ID NO: 1321, CDR-H2 as depicted in SEQ ID NO: 1322, CDR-H3 as depicted in SEQ ID NO: 1323, CDR-L1 as depicted in SEQ ID NO: 1324, CDR-L2 as depicted in SEQ ID NO: 1325 and CDR-L3 as depicted in SEQ ID NO: 1326, CDR-H1 as depicted in SEQ ID NO: 1373, CDR-H2 as depicted in SEQ ID NO: 1374, CDR-H3 as depicted in SEQ ID NO: 1375, CDR-L1 as depicted in SEQ ID NO: 1376, CDR-L2 as depicted in SEQ ID NO: 1377 and CDR-L3 as depicted in SEQ ID NO: 1378, CDR-H1 as depicted in SEQ ID NO: 1386, CDR-H2 as depicted in SEQ ID NO: 1387, CDR-H3 as depicted in SEQ ID NO: 1388, CDR-L1 as depicted in SEQ ID NO: 1389, CDR-L2 as depicted in SEQ ID NO: 1390 and CDR-L3 as depicted in SEQ ID NO: 1391, CDR-H1 as depicted in SEQ ID NO: 1399, CDR-H2 as depicted in SEQ ID NO: 1400, CDR-H3 as depicted in SEQ ID NO: 1401, CDR-L1 as depicted in SEQ ID NO: 1402, CDR-L2 as depicted in SEQ ID NO: 1403 and CDR-L3 as depicted in SEQ ID NO: 1404, CDR-H1 as depicted in SEQ ID NO: 1412, CDR-H2 as depicted in SEQ ID NO: 1413, CDR-H3 as depicted in SEQ ID NO: 1414, CDR-L1 as depicted in SEQ ID NO: 1415, CDR-L2 as depicted in SEQ ID NO: 1416 and CDR-L3 as depicted in SEQ ID NO: 1417, CDR-H1 as depicted in SEQ ID NO: 1777, CDR-H2 as depicted in SEQ ID NO: 1778, CDR-H3 as depicted in SEQ ID NO: 1779, CDR-L1 as depicted in SEQ ID NO: 1780, CDR-L2 as depicted in SEQ ID NO: 1781 and CDR-L3 as depicted in SEQ ID NO: 1782, CDR-H1 as depicted in SEQ ID NO: 1790, CDR-H2 as depicted in SEQ ID NO: 1791, CDR-H3 as depicted in SEQ ID NO: 1792, CDR-L1 as depicted in SEQ ID NO: 1793, CDR-L2 as depicted in SEQ ID NO: 1794 and CDR-L3 as depicted in SEQ ID NO: 1795, CDR-H1 as depicted in SEQ ID NO: 1803, CDR-H2 as depicted in SEQ ID NO: 1804, CDR-H3 as depicted in SEQ ID NO: 1805, CDR-L1 as depicted in SEQ ID NO: 1806, CDR-L2 as depicted in SEQ ID NO: 1807 and CDR-L3 as depicted in SEQ ID NO: 1808, CDR-H1 as depicted in SEQ ID NO: 1816, CDR-H2 as depicted in SEQ ID NO: 1817, CDR-H3 as depicted in SEQ ID NO: 1818, CDR-L1 as depicted in SEQ ID NO: 1819, CDR-L2 as depicted in SEQ ID NO: 1820 and CDR-L3 as depicted in SEQ ID NO: 1821, CDR-H1 as depicted in SEQ ID NO: 1829, CDR-H2 as depicted in SEQ ID NO: 1830, CDR-H3 as depicted in SEQ ID NO: 1831, CDR-L1 as depicted in SEQ ID NO: 1832, CDR-L2 as depicted in SEQ ID NO: 1833 and CDR-L3 as depicted in SEQ ID NO: 1834, CDR-H1 as depicted in SEQ ID NO: 1842, CDR-H2 as depicted in SEQ ID NO: 1843, CDR-H3 as depicted in SEQ ID NO: 1844, CDR-L1 as depicted in SEQ ID NO: 1845, CDR-L2 as depicted in SEQ ID NO: 1846 and CDR-L3 as depicted in SEQ ID NO: 1847, CDR-H1 as depicted in SEQ ID NO: 1855, CDR-H2 as depicted in SEQ ID NO: 1856, CDR-H3 as depicted in SEQ ID NO: 1857, CDR-L1 as depicted in SEQ ID NO: 1858, CDR-L2 as depicted in SEQ ID NO: 1859 and CDR-L3 as depicted in SEQ ID NO: 1860, CDR-H1 as depicted in SEQ ID NO: 1868, CDR-H2 as depicted in SEQ ID NO: 1869, CDR-H3 as depicted in SEQ ID NO: 1870, CDR-L1 as depicted in SEQ ID NO: 1871, CDR-L2 as depicted in SEQ ID NO: 1872 and CDR-L3 as depicted in SEQ ID NO: 1873, CDR-H1 as depicted in SEQ ID NO: 1881, CDR-H2 as depicted in SEQ ID NO: 1882, CDR-H3 as depicted in SEQ ID NO: 1883, CDR-L1 as depicted in SEQ ID NO: 1884, CDR-L2 as depicted in SEQ ID NO: 1885 and CDR-L3 as depicted in SEQ ID NO: 1886, CDR-H1 as depicted in SEQ ID NO: 2063, CDR-H2 as depicted in SEQ ID NO: 2064, CDR-H3 as depicted in SEQ ID NO: 2065, CDR-L1 as depicted in SEQ ID NO: 2066, CDR-L2 as depicted in SEQ ID NO: 2067 and CDR-L3 as depicted in SEQ ID NO: 2068, CDR-H1 as depicted in SEQ ID NO: 2076, CDR-H2 as depicted in SEQ ID NO: 2077, CDR-H3 as depicted in SEQ ID NO: 2078, CDR-L1 as depicted in SEQ ID NO: 2079, CDR-L2 as depicted in SEQ ID NO: 2080 and CDR-L3 as depicted in SEQ ID NO: 2081, CDR-H1 as depicted in SEQ ID NO: 2089, CDR-H2 as depicted in SEQ ID NO: 2090, CDR-H3 as depicted in SEQ ID NO: 2091, CDR-L1 as depicted in SEQ ID NO: 2092, CDR-L2 as depicted in SEQ ID NO: 2093 and CDR-L3 as depicted in SEQ ID NO: 2094, CDR-H1 as depicted in SEQ ID NO: 2102, CDR-H2 as depicted in SEQ ID NO: 2103, CDR-H3 as depicted in SEQ ID NO: 2104, CDR-L1 as depicted in SEQ ID NO: 2105, CDR-L2 as depicted in SEQ ID NO: 2106 and CDR-L3 as depicted in SEQ ID NO: 2107, CDR-H1 as depicted in SEQ ID NO: 2115, CDR-H2 as depicted in SEQ ID NO: 2116, CDR-H3 as depicted in SEQ ID NO: 2117, CDR-L1 as depicted in SEQ ID NO: 2118, CDR-L2 as depicted in SEQ ID NO: 2119 and CDR-L3 as depicted in SEQ ID NO: 2120, CDR-H1 as depicted in SEQ ID NO: 2128, CDR-H2 as depicted in SEQ ID NO: 2129, CDR-H3 as depicted in SEQ ID NO: 2130, CDR-L1 as depicted in SEQ ID NO: 2131, CDR-L2 as depicted in SEQ ID NO: 2132 and CDR-L3 as depicted in SEQ ID NO: 2133, CDR-H1 as depicted in SEQ ID NO: 2141, CDR-H2 as depicted in SEQ ID NO: 2142, CDR-H3 as depicted in SEQ ID NO: 2143, CDR-L1 as depicted in SEQ ID NO: 2144, CDR-L2 as depicted in SEQ ID NO: 2145 and CDR-L3 as depicted in SEQ ID NO: 2146, CDR-H1 as depicted in SEQ ID NO: 2154, CDR-H2 as depicted in SEQ ID NO: 2155, CDR-H3 as depicted in SEQ ID NO: 2156, CDR-L1 as depicted in SEQ ID NO: 2157, CDR-L2 as depicted in SEQ ID NO: 2158 and CDR-L3 as depicted in SEQ ID NO: 2159, CDR-H1 as depicted in SEQ ID NO: 2180, CDR-H2 as depicted in SEQ ID NO: 2181, CDR-H3 as depicted in SEQ ID NO: 2182, CDR-L1 as depicted in SEQ ID NO: 2183, CDR-L2 as depicted in SEQ ID NO: 2184 and CDR-L3 as depicted in SEQ ID NO: 2185, CDR-H1 as depicted in SEQ ID NO: 2193, CDR-H2 as depicted in SEQ ID NO: 2194, CDR-H3 as depicted in SEQ ID NO: 2195, CDR-L1 as depicted in SEQ ID NO: 2196, CDR-L2 as depicted in SEQ ID NO: 2197 and CDR-L3 as depicted in SEQ ID NO: 2198, and CDR-H1 as depicted in SEQ ID NO: 2206, CDR-H2 as depicted in SEQ ID NO: 2207, CDR-H3 as depicted in SEQ ID NO: 2208, CDR-L1 as depicted in SEQ ID NO: 2209, CDR-L2 as depicted in SEQ ID NO: 2210 and CDR-L3 as depicted in SEQ ID NO: 2211; and (e) CDR-H1 as depicted in SEQ ID NO: 76, CDR-H2 as depicted in SEQ ID NO: 77, CDR-H3 as depicted in SEQ ID NO: 78, CDR-L1 as depicted in SEQ ID NO: 244, CDR-L2 as depicted in SEQ ID NO: 245 and CDR-L3 as depicted in SEQ ID NO: 246, CDR-H1 as depicted in SEQ ID NO: 88, CDR-H2 as depicted in SEQ ID NO: 89, CDR-H3 as depicted in SEQ ID NO: 90, CDR-L1 as depicted in SEQ ID NO: 256, CDR-L2 as depicted in SEQ ID NO: 257 and CDR-L3 as depicted in SEQ ID NO: 258, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 112, CDR-H2 as depicted in SEQ ID NO: 113, CDR-H3 as depicted in SEQ ID NO: 114, CDR-L1 as depicted in SEQ ID NO: 280, CDR-L2 as depicted in SEQ ID NO: 281 and CDR-L3 as depicted in SEQ ID NO: 282, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 983, CDR-H2 as depicted in SEQ ID NO: 984, CDR-H3 as depicted in SEQ ID NO: 985, CDR-L1 as depicted in SEQ ID NO: 986, CDR-L2 as depicted in SEQ ID NO: 987 and CDR-L3 as depicted in SEQ ID NO: 988, CDR-H1 as depicted in SEQ ID NO: 1582, CDR-H2 as depicted in SEQ ID NO: 1583, CDR-H3 as depicted in SEQ ID NO: 1584, CDR-L1 as depicted in SEQ ID NO: 1585, CDR-L2 as depicted in SEQ ID NO: 1586 and CDR-L3 as depicted in SEQ ID NO: 1587, and CDR-H1 as depicted in SEQ ID NO: 1595, CDR-H2 as depicted in SEQ ID NO: 1596, CDR-H3 as depicted in SEQ ID NO: 1597, CDR-L1 as depicted in SEQ ID NO: 1598, CDR-L2 as depicted in SEQ ID NO: 1599 and CDR-L3 as depicted in SEQ ID NO: 1600.

In a further embodiment of the antibody construct of the invention the first binding domain comprises a VH region selected from the group consisting of VH regions (a) as depicted in SEQ ID NO: 362, SEQ ID NO: 364, SEQ ID NO: 485, SEQ ID NO: 486, SEQ ID NO: 487, SEQ ID NO: 492, SEQ ID NO: 493, SEQ ID NO: 494, SEQ ID NO: 495, SEQ ID NO: 1133, SEQ ID NO: 1172, SEQ ID NO: 1341, SEQ ID NO: 1354, SEQ ID NO: 1367, SEQ ID NO: 1432, SEQ ID NO: 1445 and SEQ ID NO: 2174;

(b) as depicted in SEQ ID NO: 342, SEQ ID NO: 366, SEQ ID NO: 370, SEQ ID NO: 344, SEQ ID NO: 372, SEQ ID NO: 368, SEQ ID NO: 496, SEQ ID NO: 497, SEQ ID NO: 498, SEQ ID NO: 499, SEQ ID NO: 500, SEQ ID NO: 508, SEQ ID NO: 509, SEQ ID NO: 510, SEQ ID NO: 511, SEQ ID NO: 512, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 1016, SEQ ID NO: 1029, SEQ ID NO: 1042, SEQ ID NO: 1081, SEQ ID NO: 1107, SEQ ID NO: 1120, SEQ ID NO: 1250, SEQ ID NO: 1263, SEQ ID NO: 1276, SEQ ID NO: 1289, SEQ ID NO: 1302, SEQ ID NO: 1654, SEQ ID NO: 1667, SEQ ID NO: 1901, SEQ ID NO: 1914, SEQ ID NO: 1940, SEQ ID NO: 1953, SEQ ID NO: 1966, SEQ ID NO: 1979, SEQ ID NO: 1992, SEQ ID NO: 2005, SEQ ID NO: 2018, SEQ ID NO: 2031, SEQ ID NO: 2044, and SEQ ID NO: 2057;

(c) as depicted in SEQ ID NO: 338, SEQ ID NO: 354, SEQ ID NO: 378, SEQ ID NO: 356, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 501, SEQ ID NO: 502, SEQ ID NO: 503, SEQ ID NO: 504, SEQ ID NO: 505, SEQ ID NO: 506, SEQ ID NO: 517, SEQ ID NO: 518, SEQ ID NO: 1003, SEQ ID NO: 1055, SEQ ID NO: 1094, SEQ ID NO: 1615, SEQ ID NO: 1628, SEQ ID NO: 1641, SEQ ID NO: 1680, SEQ ID NO: 1693, SEQ ID NO: 1706, SEQ ID NO: 1719, SEQ ID NO: 1732, SEQ ID NO: 1745, SEQ ID NO: 1758, SEQ ID NO: 1771, and SEQ ID NO: 1927;

(d) as depicted in SEQ ID NO: 352, SEQ ID NO: 360, SEQ ID NO: 388, SEQ ID NO: 386, SEQ ID NO: 340, SEQ ID NO: 346, SEQ ID NO: 374, SEQ ID NO: 348, SEQ ID NO: 390, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 488, SEQ ID NO: 489, SEQ ID NO: 490, SEQ ID NO: 491, SEQ ID NO: 513, SEQ ID NO: 514, SEQ ID NO: 515, SEQ ID NO: 516, SEQ ID NO: 540, SEQ ID NO: 541, SEQ ID NO: 542, SEQ ID NO: 543, SEQ ID NO: 977, SEQ ID NO: 1068, SEQ ID NO: 1146, SEQ ID NO: 1159, SEQ ID NO: 1185, SEQ ID NO: 1198, SEQ ID NO: 1211, SEQ ID NO: 1224, SEQ ID NO: 1237, SEQ ID NO: 1315, SEQ ID NO: 1328, SEQ ID NO: 1380, SEQ ID NO: 1393, SEQ ID NO: 1406, SEQ ID NO: 1419, SEQ ID NO: 1469, SEQ ID NO: 1478, SEQ ID NO: 1485, SEQ ID NO: 1494, SEQ ID NO: 1501, SEQ ID NO: 1508, SEQ ID NO: 1519, SEQ ID NO: 1526, SEQ ID NO: 1533, SEQ ID NO: 1542, SEQ ID NO: 1549, SEQ ID NO: 1558, SEQ ID NO: 1565, SEQ ID NO: 1784, SEQ ID NO: 1797, SEQ ID NO: 1810, SEQ ID NO: 1823, SEQ ID NO: 1836, SEQ ID NO: 1849, SEQ ID NO: 1862, SEQ ID NO: 1875, SEQ ID NO: 1888, SEQ ID NO: 2070, SEQ ID NO: 2083, SEQ ID NO: 2096, SEQ ID NO: 2109, SEQ ID NO: 2122, SEQ ID NO: 2135, SEQ ID NO: 2148, SEQ ID NO: 2161, SEQ ID NO: 2187, SEQ ID NO: 2200, and SEQ ID NO: 2213; and (e) as depicted in SEQ ID NO: 376, SEQ ID NO: 392, SEQ ID NO: 358, SEQ ID NO: 350, SEQ ID NO: 507, SEQ ID NO: 990, SEQ ID NO: 1589, and SEQ ID NO: 1602.

In another embodiment of the antibody construct of the invention the first binding domain comprises a VL region selected from the group consisting of VL regions (a) as depicted in SEQ ID NO: 418, SEQ ID NO: 420, SEQ ID NO: 580, SEQ ID NO: 581, SEQ ID NO: 582, SEQ ID NO: 587, SEQ ID NO: 588, SEQ ID NO: 589, SEQ ID NO: 590, SEQ ID NO: 1135, SEQ ID NO: 1174, SEQ ID NO: 1343, SEQ ID NO: 1356, SEQ ID NO: 1369, SEQ ID NO: 1434, SEQ ID NO: 1447 and SEQ ID NO: 2176;

(b) as depicted in SEQ ID NO: 398, SEQ ID NO: 422, SEQ ID NO: 426, SEQ ID NO: 400, SEQ ID NO: 428, SEQ ID NO: 424, SEQ ID NO: 591, SEQ ID NO: 592, SEQ ID NO: 593, SEQ ID NO: 594, SEQ ID NO: 595, SEQ ID NO: 603, SEQ ID NO: 604, SEQ ID NO: 605, SEQ ID NO: 606, SEQ ID NO: 607, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 1018, SEQ ID NO: 1031, SEQ ID NO: 1044, SEQ ID NO: 1083, SEQ ID NO: 1109, SEQ ID NO: 1122, SEQ ID NO: 1252, SEQ ID NO: 1265, SEQ ID NO: 1278, SEQ ID NO: 1291, SEQ ID NO: 1304, SEQ ID NO: 1656, SEQ ID NO: 1669, SEQ ID NO: 1903, SEQ ID NO: 1916, SEQ ID NO: 1942, SEQ ID NO: 1955, SEQ ID NO: 1968, SEQ ID NO: 1981, SEQ ID NO: 1994, SEQ ID NO: 2007, SEQ ID NO: 2020, SEQ ID NO: 2033, SEQ ID NO: 2046, and SEQ ID NO: 2059;

(c) as depicted in SEQ ID NO: 394, SEQ ID NO: 410, SEQ ID NO: 434, SEQ ID NO: 412, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 596, SEQ ID NO: 597, SEQ ID NO: 598, SEQ ID NO: 599, SEQ ID NO: 600, SEQ ID NO: 601, SEQ ID NO: 612, SEQ ID NO: 613, SEQ ID NO: 1005, SEQ ID NO: 1057, SEQ ID NO: 1096, SEQ ID NO: 1617, SEQ ID NO: 1630, SEQ ID NO: 1643, SEQ ID NO: 1682, SEQ ID NO: 1695, SEQ ID NO: 1708, SEQ ID NO: 1721, SEQ ID NO: 1734, SEQ ID NO: 1747, SEQ ID NO: 1760, SEQ ID NO: 1773, and SEQ ID NO: 1929;

(d) as depicted in SEQ ID NO: 408, SEQ ID NO: 416, SEQ ID NO: 444, SEQ ID NO: 442, SEQ ID NO: 396, SEQ ID NO: 402, SEQ ID NO: 430, SEQ ID NO: 404, SEQ ID NO: 446, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 583, SEQ ID NO: 584, SEQ ID NO: 585, SEQ ID NO: 586, SEQ ID NO: 608, SEQ ID NO: 609, SEQ ID NO: 610, SEQ ID NO: 611, SEQ ID NO: 635, SEQ ID NO: 636, SEQ ID NO: 637, SEQ ID NO: 638, SEQ ID NO: 979, SEQ ID NO: 1070, SEQ ID NO: 1148, SEQ ID NO: 1161, SEQ ID NO: 1187, SEQ ID NO: 1200, SEQ ID NO: 1213, SEQ ID NO: 1226, SEQ ID NO: 1239, SEQ ID NO: 1317, SEQ ID NO: 1330, SEQ ID NO: 1382, SEQ ID NO: 1395, SEQ ID NO: 1408, SEQ ID NO: 1421, SEQ ID NO: 1471, SEQ ID NO: 1480, SEQ ID NO: 1487, SEQ ID NO: 1496, SEQ ID NO: 1503, SEQ ID NO: 1510, SEQ ID NO: 1521, SEQ ID NO: 1528, SEQ ID NO: 1535, SEQ ID NO: 1544, SEQ ID NO: 1551, SEQ ID NO: 1560, SEQ ID NO: 1567, SEQ ID NO: 1786, SEQ ID NO: 1799, SEQ ID NO: 1812, SEQ ID NO: 1825, SEQ ID NO: 1838, SEQ ID NO: 1851, SEQ ID NO: 1864, SEQ ID NO: 1877, SEQ ID NO: 1890, SEQ ID NO: 2072, SEQ ID NO: 2085, SEQ ID NO: 2098, SEQ ID NO: 2111, SEQ ID NO: 2124, SEQ ID NO: 2137, SEQ ID NO: 2150, SEQ ID NO: 2163, SEQ ID NO: 2189, SEQ ID NO: 2202, and SEQ ID NO: 2215; and (e) as depicted in SEQ ID NO: 432, SEQ ID NO: 448, SEQ ID NO: 414, SEQ ID NO: 406, SEQ ID NO: 602, SEQ ID NO: 992, SEQ ID NO: 1591, and SEQ ID NO: 1604.

The invention further provides an embodiment of the antibody construct of the invention, wherein the first binding domain comprises a VH region and a VL region selected from the group consisting of:

(1) pairs of a VH region and a VL region as depicted in SEQ ID NOs: 362+418, SEQ ID NOs: 364+420, SEQ ID NOs: 485+580, SEQ ID NOs: 486+581, SEQ ID NOs: 487+582, SEQ ID NOs: 492+587, SEQ ID NOs: 493+588, SEQ ID NOs: 494+589, SEQ ID NOs: 495+590, SEQ ID NOs: 1133+1135, SEQ ID NOs: 1172+1174, SEQ ID NOs: 1341+1343, SEQ ID NOs: 1354+1356, SEQ ID NOs: 1367+1369, SEQ ID NOs: 1432+1434, SEQ ID NOs: 1445+1447, and SEQ ID NOs: 2174+2176;

(2) pairs of a VH region and a VL region as depicted in SEQ ID NOs: 342+398, SEQ ID NOs: 366+422, SEQ ID NOs: 370+426, SEQ ID NOs: 344+400, SEQ ID NOs: 372+428, SEQ ID NOs: 368+424, SEQ ID NOs: 496+591, SEQ ID NOs: 497+592, SEQ ID NOs: 498+593, SEQ ID NOs: 499+594, SEQ ID NOs: 500+595, SEQ ID NOs: 508+603, SEQ ID NOs: 509+604, SEQ ID NOs: 510+605, SEQ ID NOs: 511+606, SEQ ID NOs: 512+607, SEQ ID NOs: 519+614, SEQ ID NOs: 520+615, SEQ ID NOs: 521+616, SEQ ID NOs: 522+617, SEQ ID NOs: 523+618, SEQ ID NOs: 524+619, SEQ ID NOs: 525+620, SEQ ID NOs: 526+621, SEQ ID NOs: 527+622, SEQ ID NOs: 528+623, SEQ ID NOs: 529+624, SEQ ID NOs: 530+625, SEQ ID NOs: 531+626, SEQ ID NOs: 532+627, SEQ ID NOs: 533+628, SEQ ID NOs: 534+629, SEQ ID NOs: 535+630, SEQ ID NOs: 536+631, SEQ ID NOs: 537+632, SEQ ID NOs: 538+633, SEQ ID NOs: 1016+1018, SEQ ID NOs: 1029+1031, SEQ ID NOs: 1042+1044, SEQ ID NOs: 1081+1083, SEQ ID NOs: 1107+1109, SEQ ID NOs: 1120+1122, SEQ ID NOs: 1250+1252, SEQ ID NOs: 1263+1265, SEQ ID NOs: 1276+1278, SEQ ID NOs: 1289+1291, SEQ ID NOs: 1302+1304, SEQ ID NOs: 1654+1656, SEQ ID NOs: 1667+1669, SEQ ID NOs: 1901+1903, SEQ ID NOs: 1914+1916, SEQ ID NOs: 1940+1942, SEQ ID NOs: 1953+1955, SEQ ID NOs: 1966+1968, SEQ ID NOs: 1979+1981, SEQ ID NOs: 1992+1994, SEQ ID NOs: 2005+2007, SEQ ID NOs: 2018+2020, SEQ ID NOs: 2031+2033, SEQ ID NOs: 2044+2046, and SEQ ID NOs: 2057+2059;

(3) pairs of a VH region and a VL region as depicted in SEQ ID NOs: 338+394, SEQ ID NOs: 354+410, SEQ ID NOs: 378+434, SEQ ID NOs: 356+412, SEQ ID NOs: 476+571, SEQ ID NOs: 477+572, SEQ ID NOs: 478+573, SEQ ID NOs: 479+574, SEQ ID NOs: 480+575, SEQ ID NOs: 481+576, SEQ ID NOs: 482+577, SEQ ID NOs: 483+578, SEQ ID NOs: 484+579, SEQ ID NOs: 501+596, SEQ ID NOs: 502+597, SEQ ID NOs: 503+598, SEQ ID NOs: 504+599, SEQ ID NOs: 505+600, SEQ ID NOs: 506+601, SEQ ID NOs: 517+612, SEQ ID NOs: 518+613, SEQ ID NOs: 1003+1005, SEQ ID NOs: 1055+1057, SEQ ID NOs: 1094+1096, SEQ ID NOs: 1615+1617, SEQ ID NOs: 1628+1630, SEQ ID NOs: 1641+1643, SEQ ID NOs: 1680+1682, SEQ ID NOs: 1693+1695, SEQ ID NOs: 1706+1708, SEQ ID NOs: 1719+1721, SEQ ID NOs: 1732+1734, SEQ ID NOs: 1745+1747, SEQ ID NOs: 1758+1760, SEQ ID NOs: 1771+1773, and SEQ ID NOs: 1927+1929;

(4) pairs of a VH region and a VL region as depicted in SEQ ID NOs: 352+408, SEQ ID NOs: 360+416, SEQ ID NOs: 388+444, SEQ ID NOs: 386+442, SEQ ID NOs: 340+396, SEQ ID NOs: 346+402, SEQ ID NOs: 374+430, SEQ ID NOs: 348+404, SEQ ID NOs: 390+446, SEQ ID NOs: 463+558, SEQ ID NOs: 464+559, SEQ ID NOs: 465+560, SEQ ID NOs: 466+561, SEQ ID NOs: 467+562, SEQ ID NOs: 468+563, SEQ ID NOs: 469+564, SEQ ID NOs: 470+565, SEQ ID NOs: 471+566, SEQ ID NOs: 472+567, SEQ ID NOs: 473+568, SEQ ID NOs: 474+569, SEQ ID NOs: 475+570, SEQ ID NOs: 488+583, SEQ ID NOs: 489+584, SEQ ID NOs: 490+585, SEQ ID NOs: 491+586, SEQ ID NOs: 513+608, SEQ ID NOs: 514+609, SEQ ID NOs: 515+610, SEQ ID NOs: 516+611, SEQ ID NOs: 540+635, SEQ ID NOs: 541+636, SEQ ID NOs: 542+637, SEQ ID NOs: 543+638, SEQ ID NOs: 977+979, SEQ ID NOs: 1068+1070, SEQ ID NOs: 1146+1148, SEQ ID NOs: 1159+1161, SEQ ID NOs: 1185+1187, SEQ ID NOs: 1198+1200, SEQ ID NOs: 1211+1213, SEQ ID NOs: 1224+1226, SEQ ID NOs: 1237+1239, SEQ ID NOs: 1315+1317, SEQ ID NOs: 1328+1330, SEQ ID NOs: 1380+1382 SEQ ID NOs: 1393+1395, SEQ ID NOs: 1406+1408, SEQ ID NOs: 1419+1421, SEQ ID NOs: 1469+1471, SEQ ID NOs: 1478+1480, SEQ ID NOs: 1485+1487, SEQ ID NOs: 1494+1496, SEQ ID NOs: 1501+1503, SEQ ID NOs: 1508+1510, SEQ ID NOs: 1519+1521, SEQ ID NOs: 1526+1528, SEQ ID NOs: 1533+1535, SEQ ID NOs: 1542+1544, SEQ ID NOs: 1549+1551, SEQ ID NOs: 1558+1560, SEQ ID NOs: 1565+1567, SEQ ID NOs: 1784+1786, SEQ ID NOs: 1797+1799, SEQ ID NOs: 1810+1812, SEQ ID NOs: 1823+1825, SEQ ID NOs: 1836+1838, SEQ ID NOs: 1849+1851, SEQ ID NOs: 1862+1864, SEQ ID NOs: 1875+1877, SEQ ID NOs: 1888+1890, SEQ ID NOs: 2070+2072, SEQ ID NOs: 2083+2085, SEQ ID NOs: 2096+2098, SEQ ID NOs: 2109+2111, SEQ ID NOs: 2122+2124, SEQ ID NOs: 2135+2137, SEQ ID NOs: 2148+2150, SEQ ID NOs: 2161+2163, SEQ ID NOs: 2187+2189, SEQ ID NOs: 2200+2202, and SEQ ID NOs: 2213+2215; and (5) pairs of a VH region and a VL region as depicted in SEQ ID NOs: 376+432, SEQ ID NOs: 392+448, SEQ ID NOs: 358+414, SEQ ID NOs: 350+406, SEQ ID NOs: 507+602, SEQ ID NOs: 990+992, SEQ ID NOs: 1589+1591, and SEQ ID NOs: 1602+1604.

In a further embodiment of the invention the antibody construct is in a format selected from the group consisting of (scFv)$_2$, (single domain mAb)$_2$, scFv-single domain mAb, diabodies and oligomers thereof.

In a preferred embodiment the first binding domain comprises an amino acid sequence selected from the group consisting of (a) as depicted in SEQ ID NO: 117, SEQ ID NO: 1137, SEQ ID NO: 1176, SEQ ID NO: 1345, SEQ ID NO: 1358, SEQ ID NO: 1371, SEQ ID NO: 1436, SEQ ID NO: 1449 and SEQ ID NO: 2178;

(b) as depicted in SEQ ID NO: 1020, SEQ ID NO: 1033, SEQ ID NO: 1046, SEQ ID NO: 1085, SEQ ID NO: 1111, SEQ ID NO: 1124, SEQ ID NO: 1254, SEQ ID NO: 1267, SEQ ID NO: 1280, SEQ ID NO: 1293, SEQ ID NO: 1306, SEQ ID NO: 1658, SEQ ID NO: 1671, SEQ ID NO: 1905, SEQ ID NO: 1918, SEQ ID NO: 1944, SEQ ID NO: 1957, SEQ ID NO: 1970, SEQ ID NO: 1983, SEQ ID NO: 1996, SEQ ID NO: 2009, SEQ ID NO: 2022, SEQ ID NO: 2035, SEQ ID NO: 2048, and SEQ ID NO: 2061;

(c) as depicted in SEQ ID NO: 1007, SEQ ID NO: 1059, SEQ ID NO: 1098, SEQ ID NO: 1619, SEQ ID NO: 1632, SEQ ID NO: 1645, SEQ ID NO: 1684, SEQ ID NO: 1697, SEQ ID NO: 1710, SEQ ID NO: 1723, SEQ ID NO: 1736, SEQ ID NO: 1749, SEQ ID NO: 1762, SEQ ID NO: 1775, and SEQ ID NO: 1931;

(d) as depicted in SEQ ID NO: 981, SEQ ID NO: 1072, SEQ ID NO: 1150, SEQ ID NO: 1163, SEQ ID NO: 1189, SEQ ID NO: 1202, SEQ ID NO: 1215, SEQ ID NO: 1228, SEQ ID NO: 1241, SEQ ID NO: 1319, SEQ ID NO: 1332, SEQ ID NO: 1384, SEQ ID NO: 1397, SEQ ID NO: 1410, SEQ ID NO: 1423, SEQ ID NO: 1473, SEQ ID NO: 1482, SEQ ID NO: 1489, SEQ ID NO: 1498, SEQ ID NO: 1505, SEQ ID NO: 1512, SEQ ID NO: 1523, SEQ ID NO: 1530, SEQ ID NO: 1537, SEQ ID NO: 1546, SEQ ID NO: 1553, SEQ ID NO: 1562, SEQ ID NO: 1569, SEQ ID NO: 1788, SEQ ID NO: 1801, SEQ ID NO: 1814, SEQ ID NO: 1827, SEQ ID NO: 1840, SEQ ID NO: 1853, SEQ ID NO: 1866, SEQ ID NO: 1879, SEQ ID NO: 1892, SEQ ID NO: 2074, SEQ ID NO: 2087, SEQ ID NO: 2100, SEQ ID NO: 2113, SEQ ID NO: 2126, SEQ ID NO: 2139, SEQ ID NO: 2152, SEQ ID NO: 2165, SEQ ID NO: 2191, SEQ ID NO: 2204, and SEQ ID NO: 2217; and (e) as depicted in SEQ ID NO: 994, SEQ ID NO: 1593, and SEQ ID NO: 1606.

In another embodiment of the antibody construct of the invention the second binding domain is capable of binding to human and *Callithrix jacchus, Saguinus Oedipus* or *Saimiri sciureus* CD3 epsilon.

In a preferred embodiment the antibody construct of the invention has an amino acid sequence selected from the group consisting of (a) as depicted in SEQ ID NO: 1138, SEQ ID NO: 1177, SEQ ID NO: 1346, SEQ ID NO: 1359, SEQ ID NO: 1372, SEQ ID NO: 1437, SEQ ID NO: 14501450 and SEQ ID NO: 2179;

(b) as depicted in SEQ ID NO: 1021, SEQ ID NO: 1034, SEQ ID NO: 1047, SEQ ID NO: 1086, SEQ ID NO: 1112, SEQ ID NO: 1125, SEQ ID NO: 1255, SEQ ID NO: 1268, SEQ ID NO: 1281, SEQ ID NO: 1294, SEQ ID NO: 1307, SEQ ID NO: 1659, SEQ ID NO: 1672, SEQ ID NO: 1906, SEQ ID NO: 1919, SEQ ID NO: 1945, SEQ ID NO: 1958, SEQ ID NO: 1971, SEQ ID NO: 1984, SEQ ID NO: 1997, SEQ ID NO: 2010, SEQ ID NO: 2023, SEQ ID NO: 2036, SEQ ID NO: 2049, and SEQ ID NO: 2062;

(c) as depicted in SEQ ID NO: 1008, SEQ ID NO: 1060, SEQ ID NO: 1099, SEQ ID NO: 1620, SEQ ID NO: 1633, SEQ ID NO: 1646, SEQ ID NO: 1685, SEQ ID NO: 1698, SEQ ID NO: 1711, SEQ ID NO: 1724, SEQ ID NO: 1737, SEQ ID NO: 1750, SEQ ID NO: 1763, SEQ ID NO: 1776, and SEQ ID NO: 1932;

(d) as depicted in SEQ ID NO: 982, SEQ ID NO: 1073, SEQ ID NO: 1151, SEQ ID NO: 1164, SEQ ID NO: 1190, SEQ ID NO: 1203, SEQ ID NO: 1216, SEQ ID NO: 1229, SEQ ID NO: 1242, SEQ ID NO: 1320, SEQ ID NO: 1333, SEQ ID NO: 1385, SEQ ID NO: 1398, SEQ ID NO: 1411, SEQ ID NO: 1424, SEQ ID NO: 1474, SEQ ID NO: 1475, SEQ ID NO: 1476, SEQ ID NO: 1483, SEQ ID NO: 1490, SEQ ID NO: 1491, SEQ ID NO: 1492, SEQ ID NO: 1499, SEQ ID NO: 1506, SEQ ID NO: 1513, SEQ ID NO: 1514, SEQ ID NO: 1515, SEQ ID NO: 1516, SEQ ID NO: 1517, SEQ ID NO: 1524, SEQ ID NO: 1531, SEQ ID NO: 1538, SEQ ID NO: 1539, SEQ ID NO: 1540, SEQ ID NO: 1547, SEQ ID NO: 1554, SEQ ID NO: 1555, SEQ ID NO: 1556, SEQ ID NO: 1563, SEQ ID NO: 1570, SEQ ID NO: 1571, SEQ ID NO: 1572, SEQ ID NO: 1573, SEQ ID NO: 1574, SEQ ID NO: 1575, SEQ ID NO: 1576, SEQ ID NO: 1577, SEQ ID NO: 1578, SEQ ID NO: 1579, SEQ ID NO: 1580, SEQ ID NO: 1581, SEQ ID NO: 1789, SEQ ID NO: 1802, SEQ ID NO: 1815, SEQ ID NO: 1828, SEQ ID NO: 1841, SEQ ID NO: 1854, SEQ ID NO: 1867, SEQ ID NO: 1880, SEQ ID NO: 1893, SEQ ID NO: 2075, SEQ ID NO: 2088, SEQ ID NO: 2101, SEQ ID NO: 2114, SEQ ID NO: 2127, SEQ ID NO: 2140, SEQ ID NO: 2153, SEQ ID NO: 2166, SEQ ID NO: 2192, SEQ ID NO: 2205, and SEQ ID NO: 2218 to 2228; and (e) as depicted in SEQ ID NO: 995, SEQ ID NO: 1594, and SEQ ID NO: 1607.

The invention further provides a nucleic acid sequence encoding an antibody construct of the invention.

Furthermore, the invention provides a vector comprising a nucleic acid sequence of the invention. Moreover, the invention provides a host cell transformed or transfected with the nucleic acid sequence of the invention.

In a further embodiment the invention provides a process for the production of a antibody construct of the invention, said process comprising culturing a host cell of the invention under conditions allowing the expression of the antibody construct of the invention and recovering the produced antibody construct from the culture.

Moreover, the invention provides a pharmaceutical composition comprising an antibody construct of the invention or produced according to the process of the invention In one embodiment the invention provides the antibody construct of the invention or produced according to the process of the invention for use in the prevention, treatment or amelioration of a melanoma disease or metastatic melanoma disease.

The invention also provides a method for the treatment or amelioration of a melanoma disease or metastatic melanoma disease, comprising the step of administering to a subject in need thereof the antibody construct of the invention or produced according to the process of the invention.

In a preferred embodiment method of use of the invention the melanoma disease or metastatic melanoma disease is selected from the group consisting of superficial spreading melanoma, lentigo maligna, lentigo maligna melanoma, acral lentiginous melanoma and nodular melanoma.

In a further embodiment, the invention provides a kit comprising an antibody construct of the invention, or produced according to the process of the invention, a vector of the invention, and/or a host cell of the invention.

DETAILED DESCRIPTION OF THE INVENTION

Figure 1:
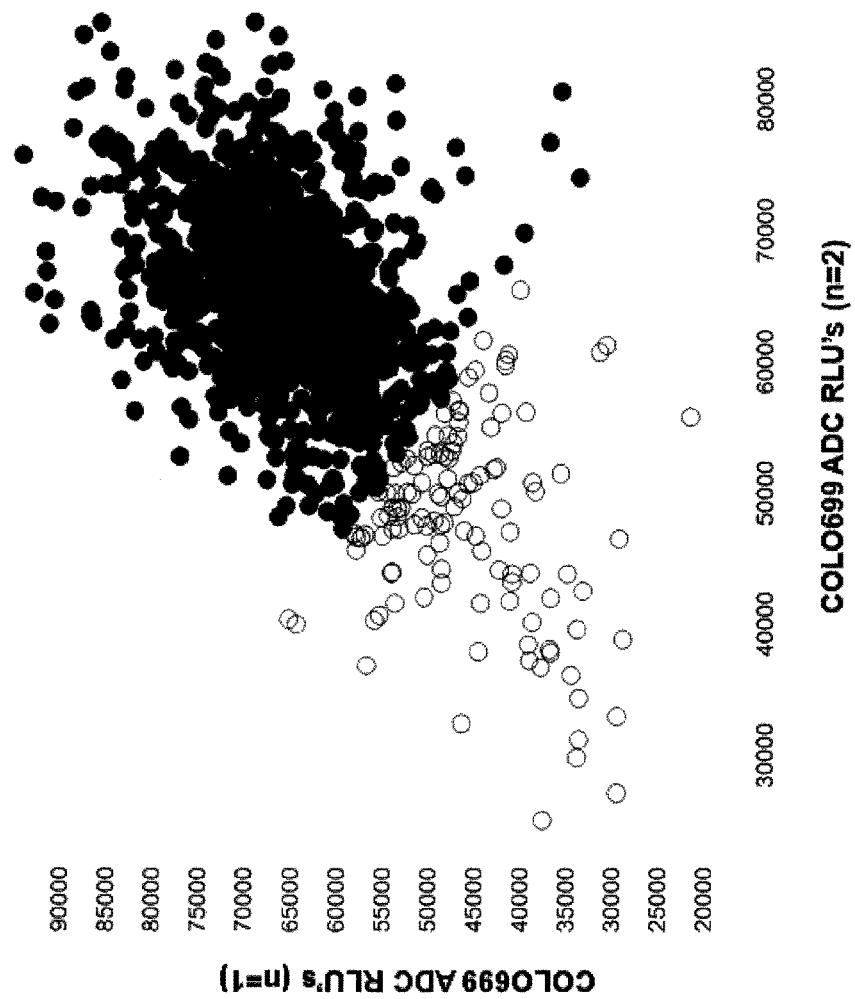
FIG. 1 depicts cell viability data of Colo-699 cells that have been treated with fully human anti-CDH19 antibodies and a high concentration of a goat anti-human Fc monovalent Fab conjugated with DM1 (DM1-Fab) at a drug-antibody ratio (DAR) (~1.3).

Definitions:

It must be noted that as used herein, the singular forms "a", "an", and "the", include plural references unless the context clearly indicates otherwise. Thus, for example, reference to "a reagent" includes one or more of such different reagents and reference to "the method" includes reference to equivalent steps and methods known to those of ordinary skill in the art that could be modified or substituted for the methods described herein.

Unless otherwise indicated, the term "at least" preceding a series of elements is to be understood to refer to every element in the series. Those skilled in the art will recognize, or be able to ascertain using no more than routine experimentation, many equivalents to the specific embodiments of the invention described herein. Such equivalents are intended to be encompassed by the present invention.

The term "and/or" wherever used herein includes the meaning of "and", "or" and "all or any other combination of the elements connected by said term".

The term "about" or "approximately" as used herein means within ±20%, preferably within ±15%, more preferably within ±10%, and most preferably within ±5% of a given value or range.

Throughout this specification and the claims which follow, unless the context requires otherwise, the word "comprise", and variations such as "comprises" and "comprising", will be understood to imply the inclusion of a stated integer or step or group of integers or steps but not the exclusion of any other integer or step or group of integer or step. When used herein the term "comprising" can be substituted with the term "containing" or "including" or sometimes when used herein with the term "having".

When used herein "consisting of" excludes any element, step, or ingredient not specified in the claim element. When used herein, "consisting essentially of" does not exclude materials or steps that do not materially affect the basic and novel characteristics of the claim.

In each instance herein any of the terms "comprising", "consisting essentially of" and "consisting of" may be replaced with either of the other two terms.

The definition of the term "antibody" includes embodiments such as monoclonal, chimeric, single chain, humanized and human antibodies, as well as antibody fragments, like, inter alia, Fab fragments. Antibody fragments or derivatives further comprise $F(ab')_2$, Fv, scFv fragments or single domain antibodies such as domain antibodies or nanobodies, single variable domain antibodies or immunoglobulin single variable domain comprising merely one variable domain, which might be VHH, VH or VL, that specifically bind an antigen or epitope independently of other V regions or domains; see, for example, Harlow and Lane (1988) and (1999), loc. cit.; Kontermann and Dübel, Antibody Engineering, Springer, 2nd ed. 2010 and Little, Recombinant Antibodies for Immunotherapy, Cambridge University Press 2009. Such immunoglobulin single variable domain encompasses not only an isolated antibody single variable domain polypeptide, but also larger polypeptides that comprise one or more monomers of an antibody single variable domain polypeptide sequence.

In line with this definition all above described embodiments of the term antibody can be subsumed under the term "antibody construct". Said term also includes diabodies or Dual-Affinity Re-Targeting (DART) antibodies. Further envisaged are (bispecific) single chain diabodies, tandem diabodies (Tandab's), "minibodies" exemplified by a structure which is as follows: $(VH-VL-CH3)_2$, $(scFv-CH3)_2$ or $(scFv-CH3-scFv)_2$, "Fc DART" antibodies and "IgG DART" antibodies, and multibodies such as triabodies. Immunoglobulin single variable domains encompass not only an isolated antibody single variable domain polypeptide, but also larger polypeptides that comprise one or more monomers of an antibody single variable domain polypeptide sequence.

Various procedures are known in the art and may be used for the production of such antibody constructs (antibodies and/or fragments). Thus, (antibody) derivatives can be produced by peptidomimetics. Further, techniques described for the production of single chain antibodies (see, inter alia, U.S. Pat. No. 4,946,778, Kontermann and Dübel (2010), loc. cit. and Little (2009), loc. cit.) can be adapted to produce single chain antibodies specific for elected polypeptide(s). Also, transgenic animals may be used to express humanized antibodies specific for polypeptides and fusion proteins of this invention. For the preparation of monoclonal antibodies, any technique, providing antibodies produced by continuous cell line cultures can be used. Examples for such techniques include the hybridoma technique (Köhler and Milstein Nature 256 (1975), 495-497), the trioma technique, the human B-cell hybridoma technique (Kozbor, Immunology Today 4 (1983), 72) and the EBV-hybridoma technique to produce human monoclonal antibodies (Cole et al., Monoclonal Antibodies and Cancer Therapy, Alan R. Liss, Inc. (1985), 77-96). Surface plasmon resonance as employed in the BIAcore system can be used to increase the efficiency of phage antibodies which bind to an epitope of a target polypeptide, such as CD3 epsilon (Schier, Human Antibodies Hybridomas 7 (1996), 97-105; Malmborg, J. Immunol. Methods 183 (1995), 7-13). It is also envisaged in the context of this invention that the term "antibody" comprises antibody constructs, which may be expressed in a host as described herein below, e.g. antibody constructs which may be transfected and/or transduced via, inter alia, viruses or plasmid vectors.

Furthermore, the term "antibody" as employed in the invention also relates to derivatives or variants of the antibodies described herein which display the same specificity as the described antibodies.

The terms "antigen-binding domain", "antigen-binding fragment" and "antibody binding region" when used herein refer to a part of an antibody molecule that comprises amino acids responsible for the specific binding between antibody and antigen. The part of the antigen that is specifically recognized and bound by the antibody is referred to as the "epitope" as described herein above. As mentioned above, an antigen-binding domain may typically comprise an antibody light chain variable region (VL) and an antibody heavy chain variable region (VH); however, it does not have to comprise both. Fd fragments, for example, have two VH regions and often retain some antigen-binding function of the intact antigen-binding domain. Examples of antigen-binding fragments of an antibody include (1) a Fab fragment, a monovalent fragment having the VL, VH, CL and CH1 domains; (2) a F(ab')2 fragment, a bivalent fragment having two Fab fragments linked by a disulfide bridge at the hinge region; (3) a Fd fragment having the two VH and CH1 domains; (4) a Fv fragment having the VL and VH domains of a single arm of an antibody, (5) a dAb fragment (Ward et al., (1989) Nature 341:544-546), which has a VH domain; (6) an isolated complementarity determining region (CDR), and (7) a single chain Fv (scFv). Although the two domains of the Fv fragment, VL and VH are coded for by separate genes, they can be joined, using recombinant methods, by a synthetic linker that enables them to be made as a single protein chain in which the VL and VH regions pair to form monovalent molecules (known as single chain Fv (scFv); see e.g., Huston et al. (1988) Proc. Natl. Acad. Sci USA 85:5879-5883). These antibody fragments are obtained using conventional techniques known to those with skill in the art, and the fragments are evaluated for function in the same manner as are intact antibodies.

The term "monoclonal antibody" as used herein refers to an antibody obtained from a population of substantially homogeneous antibodies, i.e., the individual antibodies comprising the population are identical except for possible naturally occurring mutations and/or post-translation modifications (e.g., isomerizations, amidations) that may be present in minor amounts. Monoclonal antibodies are highly specific, being directed against a single antigenic site. Furthermore, in contrast to conventional (polyclonal) antibody preparations which typically include different antibodies directed against different determinants (epitopes), each monoclonal antibody is directed against a single determinant on the antigen. In addition to their specificity, the monoclonal antibodies are advantageous in that they are synthesized by the hybridoma culture, uncontaminated by other immunoglobulins. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler et al., Nature, 256: 495 (1975), or may be made by recombinant DNA methods (see, e.g., U.S. Pat. No. 4,816,567). The "monoclonal antibodies" may also be isolated from phage antibody libraries using the techniques described in Clackson et al., Nature, 352: 624-628 (1991) and Marks et al., J. Mol. Biol., 222: 581-597 (1991), for example.

The term "human antibody" includes antibodies having variable and constant regions corresponding substantially to human germline immunoglobulin sequences known in the art, including, for example, those described by Kabat et al. (See Kabat et al. (1991) loc. cit.). The human antibodies of the invention may include amino acid residues not encoded by human germline immunoglobulin sequences (e.g., mutations introduced by random or site-specific mutagenesis in vitro or by somatic mutation in vivo), for example in the CDRs, and in particular, CDR3. The human antibody can have at least one, two, three, four, five, or more positions replaced with an amino acid residue that is not encoded by the human germline immunoglobulin sequence. It is emphasized that the definition of human antibodies as used herein also contemplates fully human antibodies, which include only non-artificially and/or genetically altered human sequences of antibodies as those can be derived by using technologies using systems such as the Xenomice.

Examples of "antibody variants" include humanized variants of non-human antibodies, "affinity matured" antibodies (see, e.g. Hawkins et al. J. Mol. Biol. 254, 889-896 (1992) and Lowman et al., Biochemistry 30, 10832-10837 (1991)) and antibody mutants with altered effector function (s) (see, e.g., U.S. Pat. No. 5,648,260, Kontermann and Dübel (2010), loc. cit. and Little (2009), loc. cit.).

As used herein, "in vitro generated antibody" refers to an antibody where all or part of the variable region (e.g., at least one CDR) is generated in a non-immune cell selection (e.g., an in vitro phage display, protein chip or any other method in which candidate sequences can be tested for their ability to bind to an antigen). This term thus preferably excludes sequences generated by genomic rearrangement in an immune cell.

The pairing of a VH and VL together forms a single antigen-binding site. The CH domain most proximal to VH is designated as CH1. Each L chain is linked to an H chain by one covalent disulfide bond, while the two H chains are linked to each other by one or more disulfide bonds depending on the H chain isotype. The VH and VL domains consist of four regions of relatively conserved sequences called framework regions (FR1, FR2, FR3, and FR4), which form a scaffold for three regions of hypervariable sequences (complementarity determining regions, CDRs). The CDRs contain most of the residues responsible for specific interactions of the antibody with the antigen. CDRs are referred to as CDR1, CDR2, and CDR3. Accordingly, CDR constituents on the heavy chain are referred to as H1, H2, and H3, while CDR constituents on the light chain are referred to as L1, L2, and L3.

The term "variable" refers to the portions of the immunoglobulin domains that exhibit variability in their sequence and that are involved in determining the specificity and binding affinity of a particular antibody (i.e., the "variable domain(s)"). Variability is not evenly distributed throughout the variable domains of antibodies; it is concentrated in sub-domains of each of the heavy and light chain variable regions. These sub-domains are called "hypervariable" regions or "complementarity determining regions" (CDRs). The more conserved (i.e., non-hypervariable) portions of the variable domains are called the "framework" regions (FRM). The variable domains of naturally occurring heavy and light chains each comprise four FRM regions, largely adopting a β-sheet configuration, connected by three hypervariable regions, which form loops connecting, and in some cases forming part of, the β-sheet structure. The hypervariable regions in each chain are held together in close proximity by the FRM and, with the hypervariable regions from the other chain, contribute to the formation of the antigen-binding site (see Kabat et al., loc. cit.). The constant domains are not directly involved in antigen binding, but exhibit various effector functions, such as, for example, antibody-dependent, cell-mediated cytotoxicity and complement activation.

The terms "CDR", and its plural "CDRs", refer to a complementarity determining region (CDR) of which three make up the binding character of a light chain variable region (CDRL1, CDRL2 and CDRL3) and three make up the binding character of a heavy chain variable region (CDRH1, CDRH2 and CDRH3). CDRs contribute to the functional activity of an antibody molecule and are separated by amino acid sequences that comprise scaffolding or framework regions. The exact definitional CDR boundaries and lengths are subject to different classification and numbering systems. CDRs may therefore be referred to by Kabat, Chothia, contact or any other boundary definitions, including the numbering system described herein. Despite differing boundaries, each of these systems has some degree of overlap in what constitutes the so called "hypervariable regions" within the variable sequences. CDR definitions according to these systems may therefore differ in length and boundary areas with respect to the adjacent framework region. See for example Kabat, Chothia, and/or MacCallum (Kabat et al., loc. cit.; Chothia et al., J. Mol. Biol, 1987, 196: 901; and MacCallum et al., J. Mol. Biol, 1996, 262: 732). However, the numbering in accordance with the so-called Kabat system is preferred. The CDR3 of the light chain and, particularly, CDR3 of the heavy chain may constitute the most important determinants in antigen binding within the light and heavy chain variable regions. In some antibody constructs, the heavy chain CDR3 appears to constitute the major area of contact between the antigen and the antibody. In vitro selection schemes in which CDR3 alone is varied can be used to vary the binding properties of an antibody or determine which residues contribute to the binding of an antigen.

"Consisting essentially of" means that the amino acid sequence can vary by about 1, 2, 3, 4, 5, 6, 7, 8, 9, 10, 11, 12, 13, 14, or 15% relative to the recited SEQ ID NO: sequence and still retain biological activity, as described herein.

In some embodiments, the antibody constructs of the invention are isolated proteins or substantially pure proteins. An "isolated" protein is unaccompanied by at least some of the material with which it is normally associated in its natural state, for example constituting at least about 5%, or at least about 50% by weight of the total protein in a given sample. It is understood that the isolated protein may constitute from 5 to 99.9% by weight of the total protein content depending on the circumstances. For example, the protein may be made at a significantly higher concentration through the use of an inducible promoter or high expression promoter, such that the protein is made at increased concentration levels. The definition includes the production of an antigen binding protein in a wide variety of organisms and/or host cells that are known in the art.

For amino acid sequences, sequence identity and/or similarity is determined by using standard techniques known in the art, including, but not limited to, the local sequence identity algorithm of Smith and Waterman, 1981, *Adv. Appl. Math.* 2:482, the sequence identity alignment algorithm of Needleman and Wunsch, 1970, *J. Mol. Biol.* 48:443, the search for similarity method of Pearson and Lipman, 1988, *Proc. Nat. Acad. Sci. U.S.A.* 85:2444, computerized implementations of these algorithms (GAP, BESTFIT, FASTA, and TFASTA in the Wisconsin Genetics Software Package, Genetics Computer Group, 575 Science Drive, Madison, Wis.), the Best Fit sequence program described by Devereux et al., 1984, *Nucl. Acid Res.* 12:387-395, preferably using the default settings, or by inspection. Preferably, percent identity is calculated by FastDB based upon the following parameters: mismatch penalty of 1; gap penalty of 1; gap size penalty of 0.33; and joining penalty of 30, "Current Methods in Sequence Comparison and Analysis," Macromolecule Sequencing and Synthesis, Selected Methods and Applications, pp 127-149 (1988), Alan R. Liss, Inc.

An example of a useful algorithm is PILEUP. PILEUP creates a multiple sequence alignment from a group of related sequences using progressive, pairwise alignments. It can also plot a tree showing the clustering relationships used to create the alignment. PILEUP uses a simplification of the progressive alignment method of Feng & Doolittle, 1987, *J. Mol. Evol.* 35:351-360; the method is similar to that described by Higgins and Sharp, 1989, *CABIOS* 5:151-153. Useful PILEUP parameters including a default gap weight of 3.00, a default gap length weight of 0.10, and weighted end gaps.

Another example of a useful algorithm is the BLAST algorithm, described in: Altschul et al., 1990, *J. Mol. Biol.* 215:403-410; Altschul et al., 1997, *Nucleic Acids Res.* 25:3389-3402; and Karin et al., 1993, *Proc. Natl. Acad. Sci. U.S.A.* 90:5873-5787. A particularly useful BLAST program is the WU-BLAST-2 program which was obtained from Altschul et al., 1996, *Methods in Enzymology* 266:460-480. WU-BLAST-2 uses several search parameters, most of which are set to the default values. The adjustable parameters are set with the following values: overlap span=1, overlap fraction=0.125, word threshold (T)=II. The HSP S and HSP S2 parameters are dynamic values and are established by the program itself depending upon the composition of the particular sequence and composition of the particular database against which the sequence of interest is being searched; however, the values may be adjusted to increase sensitivity.

An additional useful algorithm is gapped BLAST as reported by Altschul et al., 1993, *Nucl. Acids Res.* 25:3389-3402. Gapped BLAST uses BLOSUM-62 substitution scores; threshold T parameter set to 9; the two-hit method to trigger ungapped extensions, charges gap lengths of k a cost of 10+k; Xu set to 16, and Xg set to 40 for database search stage and to 67 for the output stage of the algorithms. Gapped alignments are triggered by a score corresponding to about 22 bits.

Generally, the amino acid homology, similarity, or identity between individual variant CDRs are at least 80% to the sequences depicted herein, and more typically with preferably increasing homologies or identities of at least 85%, 90%, 91%, 92%, 93%, 94%, 95%, 96%, 97%, 98%, 99%, and almost 100%. In a similar manner, "percent (%) nucleic acid sequence identity" with respect to the nucleic acid sequence of the binding proteins identified herein is defined as the percentage of nucleotide residues in a candidate sequence that are identical with the nucleotide residues in the coding sequence of the antigen binding protein. A specific method utilizes the BLASTN module of WU-BLAST-2 set to the default parameters, with overlap span and overlap fraction set to 1 and 0.125, respectively.

Generally, the nucleic acid sequence homology, similarity, or identity between the nucleotide sequences encoding individual variant CDRs and the nucleotide sequences depicted herein are at least 80%, and more typically with preferably increasing homologies or identities of at least 80%, 81%, 82%, 83%, 84%, 85%, 86%, 87%, 88%, 89%, 90%, 91%, 92%, 93%, 94%, 95%, 96%, 97%, 98%, or 99%, and almost 100%.

Thus, a "variant CDR" is one with the specified homology, similarity, or identity to the parent CDR of the invention, and shares biological function, including, but not limited to, at least 80%, 81%, 82%, 83%, 84%, 85%, 86%, 87%, 88%, 89%, 90%, 91%, 92%, 93%, 94%, 95%, 96%, 97%, 98%, or 99% of the specificity and/or activity of the parent CDR.

While the site or region for introducing an amino acid sequence variation is predetermined, the mutation per se need not be predetermined. For example, in order to optimize the performance of a mutation at a given site, random mutagenesis may be conducted at the target codon or region and the expressed antigen binding protein CDR variants screened for the optimal combination of desired activity. Techniques for making substitution mutations at predetermined sites in DNA having a known sequence are well known, for example, M13 primer mutagenesis and PCR mutagenesis. Screening of the mutants is done using assays of antigen binding protein activities, such as CDH19 binding.

The term "amino acid" or "amino acid residue" typically refers to an amino acid having its art recognized definition such as an amino acid selected from the group consisting of: alanine (Ala or A); arginine (Arg or R); asparagine (Asn or N); aspartic acid (Asp or D); cysteine (Cys or C); glutamine (Gln or Q); glutamic acid (Glu or E); glycine (Gly or G); histidine (His or H); isoleucine (He or I): leucine (Leu or L);

lysine (Lys or K); methionine (Met or M); phenylalanine (Phe or F); pro line (Pro or P); serine (Ser or S); threonine (Thr or T); tryptophan (Trp or W); tyrosine (Tyr or Y); and valine (Val or V), although modified, synthetic, or rare amino acids may be used as desired. Generally, amino acids can be grouped as having a nonpolar side chain (e.g., Ala, Cys, He, Leu, Met, Phe, Pro, Val); a negatively charged side chain (e.g., Asp, Glu); a positively charged sidechain (e.g., Arg, His, Lys); or an uncharged polar side chain (e.g., Asn, Cys, Gln, Gly, His, Met, Phe, Ser, Thr, Trp, and Tyr).

The term "hypervariable region" (also known as "complementarity determining regions" or CDRs) when used herein refers to the amino acid residues of an antibody which are (usually three or four short regions of extreme sequence variability) within the V-region domain of an immunoglobulin which form the antigen-binding site and are the main determinants of antigen specificity. There are at least two methods for identifying the CDR residues: (1) An approach based on cross-species sequence variability (i.e., Kabat et al., loc. cit.); and (2) An approach based on crystallographic studies of antigen-antibody complexes (Chothia, C. et al., J. Mol. Biol. 196: 901-917 (1987)). However, to the extent that two residue identification techniques define regions of overlapping, but not identical regions, they can be combined to define a hybrid CDR. However, in general, the CDR residues are preferably identified in accordance with the so-called Kabat (numbering) system.

The term "framework region" refers to the art-recognized portions of an antibody variable region that exist between the more divergent (i.e., hypervariable) CDRs. Such framework regions are typically referred to as frameworks 1 through 4 (FR1, FR2, FR3, and FR4) and provide a scaffold for the presentation of the six CDRs (three from the heavy chain and three from the light chain) in three dimensional space, to form an antigen-binding surface.

Typically, CDRs form a loop structure that can be classified as a canonical structure. The term "canonical structure" refers to the main chain conformation that is adopted by the antigen binding (CDR) loops. From comparative structural studies, it has been found that five of the six antigen binding loops have only a limited repertoire of available conformations. Each canonical structure can be characterized by the torsion angles of the polypeptide backbone. Correspondent loops between antibodies may, therefore, have very similar three dimensional structures, despite high amino acid sequence variability in most parts of the loops (Chothia and Lesk, J. Mol. Biol., 1987, 196: 901; Chothia et al., Nature, 1989, 342: 877; Martin and Thornton, J. Mol. Biol, 1996, 263: 800, each of which is incorporated by reference in its entirety). Furthermore, there is a relationship between the adopted loop structure and the amino acid sequences surrounding it. The conformation of a particular canonical class is determined by the length of the loop and the amino acid residues residing at key positions within the loop, as well as within the conserved framework (i.e., outside of the loop). Assignment to a particular canonical class can therefore be made based on the presence of these key amino acid residues. The term "canonical structure" may also include considerations as to the linear sequence of the antibody, for example, as catalogued by Kabat (Kabat et al., loc. cit.). The Kabat numbering scheme (system) is a widely adopted standard for numbering the amino acid residues of an antibody variable domain in a consistent manner and is the preferred scheme applied in the present invention as also mentioned elsewhere herein. Additional structural considerations can also be used to determine the canonical structure of an antibody. For example, those differences not fully reflected by Kabat numbering can be described by the numbering system of Chothia et al and/or revealed by other techniques, for example, crystallography and two or three-dimensional computational modeling. Accordingly, a given antibody sequence may be placed into a canonical class which allows for, among other things, identifying appropriate chassis sequences (e.g., based on a desire to include a variety of canonical structures in a library). Kabat numbering of antibody amino acid sequences and structural considerations as described by Chothia et al., loc. cit. and their implications for construing canonical aspects of antibody structure, are described in the literature.

CDR3 is typically the greatest source of molecular diversity within the antibody-binding site. H3, for example, can be as short as two amino acid residues or greater than 26 amino acids. The subunit structures and three-dimensional configurations of different classes of immunoglobulins are well known in the art. For a review of the antibody structure, see Antibodies: A Laboratory Manual, Cold Spring Harbor Laboratory, eds. Harlow et al., 1988. One of skill in the art will recognize that each subunit structure, e.g., a CH, VH, CL, VL, CDR, FR structure, comprises active fragments, e.g., the portion of the VH, VL, or CDR subunit the binds to the antigen, i.e., the antigen-binding fragment, or, e.g., the portion of the CH subunit that binds to and/or activates, e.g., an Fc receptor and/or complement. The CDRs typically refer to the Kabat CDRs, as described in Sequences of Proteins of immunological Interest, US Department of Health and Human Services (1991), eds. Kabat et al. Another standard for characterizing the antigen binding site is to refer to the hypervariable loops as described by Chothia. See, e.g., Chothia, et al. (1987; J. Mol. Biol. 227:799-817); and Tomlinson et al. (1995) EMBO J. 14: 4628-4638. Still another standard is the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S. and Kontermann, R., Springer-Verlag, Heidelberg). Embodiments described with respect to Kabat CDRs can alternatively be implemented using similar described relationships with respect to Chothia hypervariable loops or to the AbM-defined loops.

The sequence of antibody genes after assembly and somatic mutation is highly varied, and these varied genes are estimated to encode $10^{10}$ different antibody molecules (Immunoglobulin Genes, $2^{nd}$ ed., eds. Jonio et al., Academic Press, San Diego, Calif., 1995). Accordingly, the immune system provides a repertoire of immunoglobulins. The term "repertoire" refers to at least one nucleotide sequence derived wholly or partially from at least one sequence encoding at least one immunoglobulin. The sequence(s) may be generated by rearrangement in vivo of the V, D, and J segments of heavy chains, and the V and J segments of light chains. Alternatively, the sequence(s) can be generated from a cell in response to which rearrangement occurs, e.g., in vitro stimulation. Alternatively, part or all of the sequence(s) may be obtained by DNA splicing, nucleotide synthesis, mutagenesis, and other methods, see, e.g., U.S. Pat. No. 5,565,332. A repertoire may include only one sequence or may include a plurality of sequences, including ones in a genetically diverse collection.

The term "binding molecule" or "antibody construct" in the sense of the present disclosure indicates any molecule capable of (specifically) binding to, interacting with or recognizing the target molecules CDH19 and CD3. Such molecules or constructs may include proteinaceous parts and non-proteinaceous parts (e.g. chemical linkers or chemical cross-linking agents such as glutaraldehyde).

In the event that a linker is used, this linker is preferably of a length and sequence sufficient to ensure that each of the first and second domains can, independently from one another, retain their differential binding specificities. Most preferably and as documented in the appended examples, the antibody construct of the invention is a "bispecific single chain antibody construct", more preferably a bispecific single chain Fv (scFv). Bispecific single chain molecules are known in the art and are described in WO 99/54440, Mack, J. Immunol. (1997), 158, 3965-3970, Mack, PNAS, (1995), 92, 7021-7025, Kufer, Cancer Immunol. Immunother., (1997), 45, 193-197, Löffler, Blood, (2000), 95, 6, 2098-2103, Brühl, Immunol., (2001), 166, 2420-2426, Kipriyanov, J. Mol. Biol., (1999), 293, 41-56.

The said variable domains comprised in the herein described antibody constructs may be connected by additional linker sequences. The term "peptide linker" defines in accordance with the present invention an amino acid sequence by which the amino acid sequences of the first domain and the second domain of the antibody construct of the invention are linked with each other. An essential technical feature of such peptide linker is that said peptide linker does not comprise any polymerization activity. Among the suitable peptide linkers are those described in U.S. Pat. Nos. 4,751,180 and 4,935,233 or WO 88/09344. A preferred embodiment of a peptide linker is characterized by the amino acid sequence Gly-Gly-Gly-Gly-Ser, i.e. $Gly_4Ser$, or polymers thereof, i.e. $(Gly_4Ser)x$, where x is an integer 1 or greater. The characteristics of said peptide linker, which comprise the absence of the promotion of secondary structures are known in the art and described e.g. in Dall'Acqua et al. (Biochem. (1998) 37, 9266-9273), Cheadle et al. (Mol Immunol (1992) 29, 21-30) and Raag and Whitlow (FASEB (1995) 9(1), 73-80). Peptide linkers which also do not promote any secondary structures are preferred. The linkage of said domains to each other can be provided by, e.g. genetic engineering, as described in the examples. Methods for preparing fused and operatively linked bispecific single chain constructs and expressing them in mammalian cells or bacteria are well-known in the art (e.g. WO 99/54440 or Sambrook et al., Molecular Cloning: A Laboratory Manual, Cold Spring Harbor Laboratory Press, Cold Spring Harbor, N.Y., 2001).

For peptide linkers, which connect the at least two binding domains in the antibody construct of the invention peptide linkers are preferred which comprise only a few number of amino acid residues, e.g. 12 amino acid residues or less. Thus, peptide linker of 12, 11, 10, 9, 8, 7, 6 or 5 amino acid residues are preferred. An envisaged peptide linker with less than 5 amino acids comprises 4, 3, 2 or one amino acid(s) wherein Gly-rich linkers are preferred. A particularly preferred "single" amino acid in context of said "peptide linker" is Gly. Accordingly, said peptide linker may consist of the single amino acid Gly.

The term "multispecific" as used herein refers to a binding molecule which is an antibody construct and comprises at least a first and a second binding domain, wherein the first binding domain is capable of binding to one antigen or target, and the second binding domain is capable of binding to another antigen or target. Accordingly, antibody constructs according to the invention comprise at least specificities for two different antigens or targets and are at least bispecific. The "antibody construct" of the invention also comprises multispecific binding molecules such as e.g. trispecific binding molecules, the latter ones including three binding domains.

It is also envisaged that the antibody construct of the invention has, in addition to its function to bind to the target molecules CDH19 and CD3, a further function. In this format, the antibody construct is a tri- or multifunctional antibody construct by targeting plasma cells through binding to CDH19, mediating cytotoxic T cell activity through CD3 binding and providing a further function such as a fully functional Fc constant domain mediating antibody-dependent cellular cytotoxicity through recruitment of effector cells like NK cells, a label (fluorescent etc.), a therapeutic agent such as, e.g. a toxin or radionuclide, and/or means to enhance serum half-life, etc.

The term "binding domain" characterizes in connection with the present invention a domain which is capable of specifically binding to/interacting with a given target epitope or a given target site on the target molecules CDH19 and CD3.

Binding domains can be derived from a binding domain donor such as for example an antibody. It is envisaged that a binding domain of the present invention comprises at least said part of any of the aforementioned binding domains that is required for binding to/interacting with a given target epitope or a given target site on the target molecules CDH19 and CD3.

It is envisaged that the binding domain of the aforementioned binding domain donors is characterized by that part of these donors that is responsible for binding the respective target, i.e. when that part is removed from the binding domain donor, said donor loses its binding capability. "Loses" means a reduction of at least 50% of the binding capability when compared with the binding donor. Methods to map these binding sites are well known in the art—it is therefore within the standard knowledge of the skilled person to locate/map the binding site of a binding domain donor and, thereby, to "derive" said binding domain from the respective binding domain donors.

The term "epitope" refers to a site on an antigen to which a binding domain, such as an antibody or immunoglobulin or derivative or fragment of an antibody or of an immunoglobulin, specifically binds. An "epitope" is antigenic and thus the term epitope is sometimes also referred to herein as "antigenic structure" or "antigenic determinant". Thus, the binding domain is an "antigen-interaction-site". Said binding/interaction is also understood to define a "specific recognition". In one example, said binding domain which (specifically) binds to/interacts with a given target epitope or a given target site on the target molecules CDH19 and CD3 is an antibody or immunoglobulin, and said binding domain is a VH and/or VL region of an antibody or of an immunoglobulin.

"Epitopes" can be formed both by contiguous amino acids or non-contiguous amino acids juxtaposed by tertiary folding of a protein. A "linear epitope" is an epitope where an amino acid primary sequence comprises the recognized epitope. A linear epitope typically includes at least 3 or at least 4, and more usually, at least 5 or at least 6 or at least 7, for example, about 8 to about 10 amino acids in a unique sequence.

A "conformational epitope", in contrast to a linear epitope, is an epitope wherein the primary sequence of the amino acids comprising the epitope is not the sole defining component of the epitope recognized (e.g., an epitope wherein the primary sequence of amino acids is not necessarily recognized by the binding domain). Typically a conformational epitope comprises an increased number of amino acids relative to a linear epitope. With regard to recognition of conformational epitopes, the binding domain recognizes a three-dimensional structure of the antigen, preferably a peptide or protein or fragment thereof (in the context of the present invention, the antigen for one of the binding domains is comprised within the CDH19 protein). For example, when a protein molecule folds to form a three-dimensional structure, certain amino acids and/or the polypeptide backbone forming the conformational epitope become juxtaposed enabling the antibody to recognize the epitope. Methods of determining the conformation of epitopes include, but are not limited to, x-ray crystallography, two-dimensional nuclear magnetic resonance (2D-NMR) spectroscopy and site-directed spin labelling and electron paramagnetic resonance (EPR) spectroscopy. Moreover, the provided examples describe a further method to characterize a given binding domain by way of binning, which includes a test whether the given binding domain binds to one or more epitope cluster(s) of a given protein, in particular CDH19.

As used herein, the term "epitope cluster" denotes the entirety of epitopes lying in a defined contiguous stretch of an antigen. An epitope cluster can comprise one, two or more epitopes. The concept of epitope cluster is also used in the characterization of the features of the antibody constructs of the invention.

The terms "(capable of) binding to", "specifically recognizing", "directed to" and "reacting with" mean in accordance with this invention that a binding domain is capable of specifically interacting with one or more, preferably at least two, more preferably at least three and most preferably at least four amino acids of an epitope.

As used herein, the terms "specifically interacting", "specifically binding" or "specifically bind(s)" mean that a binding domain exhibits appreciable affinity for a particular protein or antigen and, generally, does not exhibit significant reactivity with proteins or antigens other than CDH19 or CD3. "Appreciable affinity" includes binding with an affinity of about $10^{-6}$M (KD) or stronger. Preferably, binding is considered specific when binding affinity is about $10^{-12}$ to $10^{-8}$ M, $10^{-12}$ to $10^{-9}$ M, $10^{-12}$ to $10^{-10}$ M, $10^{-11}$ to $10^{-8}$ M, preferably of about $10^{-11}$ to $10^{-9}$ M. Whether a binding domain specifically reacts with or binds to a target can be tested readily by, inter alia, comparing the reaction of said binding domain with a target protein or antigen with the reaction of said binding domain with proteins or antigens other than CDH19 or CD3. Preferably, a binding domain of the invention does not essentially bind or is not capable of binding to proteins or antigens other than CDH19 or CD3 (i.e. the first binding domain is not capable of binding to proteins other than CDH19 and the second binding domain is not capable of binding to proteins other than CD3).

The term "does not essentially bind", or "is not capable of binding" means that a binding domain of the present invention does not bind another protein or antigen other than CDH19 or CD3, i.e., does not show reactivity of more than 30%, preferably not more than 20%, more preferably not more than 10%, particularly preferably not more than 9%, 8%, 7%, 6% or 5% with proteins or antigens other than CDH19 or CD3, whereby binding to CDH19 or CD3, respectively, is set to be 100%.

Specific binding is believed to be effected by specific motifs in the amino acid sequence of the binding domain and the antigen. Thus, binding is achieved as a result of their primary, secondary and/or tertiary structure as well as the result of secondary modifications of said structures. The specific interaction of the antigen-interaction-site with its specific antigen may result in a simple binding of said site to the antigen. Moreover, the specific interaction of the antigen-interaction-site with its specific antigen may alternatively or additionally result in the initiation of a signal, e.g. due to the induction of a change of the conformation of the antigen, an oligomerization of the antigen, etc.

Proteins (including fragments thereof, preferably biologically active fragments, and peptides, usually having less than 30 amino acids) comprise one or more amino acids coupled to each other via a covalent peptide bond (resulting in a chain of amino acids). The term "polypeptide" as used herein describes a group of molecules, which consist of more than 30 amino acids. Polypeptides may further form multimers such as dimers, trimers and higher oligomers, i.e. consisting of more than one polypeptide molecule. Polypeptide molecules forming such dimers, trimers etc. may be identical or non-identical. The corresponding higher order structures of such multimers are, consequently, termed homo- or heterodimers, homo- or heterotrimers etc. An example for a hereteromultimer is an antibody molecule, which, in its naturally occurring form, consists of two identical light polypeptide chains and two identical heavy polypeptide chains. The terms "polypeptide" and "protein" also refer to naturally modified polypeptides/proteins wherein the modification is effected e.g. by post-translational modifications like glycosylation, acetylation, phosphorylation and the like. A "polypeptide" when referred to herein may also be chemically modified such as pegylated. Such modifications are well known in the art.

"Isolated" when used to describe the antibody construct disclosed herein, means a antibody construct that has been identified, separated and/or recovered from a component of its production environment. Preferably, the isolated antibody construct is free of association with all other components from its production environment. Contaminant components of its production environment, such as that resulting from recombinant transfected cells, are materials that would typically interfere with diagnostic or therapeutic uses for the polypeptide, and may include enzymes, hormones, and other proteinaceous or non-proteinaceous solutes. In preferred embodiments, the antibody construct will be purified (1) to a degree sufficient to obtain at least 15 residues of N-terminal or internal amino acid sequence by use of a spinning cup sequenator, or (2) to homogeneity by SDS-PAGE under non-reducing or reducing conditions using Coomassie blue or, preferably, silver stain. Ordinarily, however, an isolated antibody will be prepared by at least one purification step.

Amino acid sequence modifications of the antibody constructs described herein are contemplated. For example, it may be desirable to improve the binding affinity and/or other biological properties of the antibody. Amino acid sequence variants of the antibody constructs are prepared by introducing appropriate nucleotide changes into the antibody constructs nucleic acid, or by peptide synthesis.

Such modifications include, for example, deletions from, and/or insertions into, and/or substitutions of, residues within the amino acid sequences of the antibody constructs. Any combination of deletion, insertion, and substitution is made to arrive at the final construct, provided that the final construct possesses the desired characteristics. The amino acid changes also may alter post-translational processes of the antibody constructs, such as changing the number or position of glycosylation sites. Preferably, 1, 2, 3, 4, 5, 6, 7, 8, 9, or 10 amino acids may be substituted in a CDR, while 1, 2, 3, 4, 5, 6, 7, 8, 9, 10, 11, 12, 13, 14, 15, 16, 17, 18, 19, 20, or 25 amino acids may be substituted in the framework regions (FRs). The substitutions are preferably conservative substitutions as described herein. Additionally or alternatively, 1, 2, 3, 4, 5, or 6 amino acids may be inserted or deleted in each of the CDRs (of course, dependent on their length), while 1, 2, 3, 4, 5, 6, 7, 8, 9, 10, 11, 12, 13, 14, 15, 16, 17, 18, 19, 20, or 25 amino acids may be inserted or deleted in each of the FRs.

A useful method for identification of certain residues or regions of the antibody constructs that are preferred locations for mutagenesis is called "alanine scanning mutagenesis" as described by Cunningham and Wells in Science, 244: 1081-1085 (1989). Here, a residue or group of target residues within the antibody construct is/are identified (e.g. charged residues such as arg, asp, his, lys, and glu) and replaced by a neutral or negatively charged amino acid (most preferably alanine or polyalanine) to affect the interaction of the amino acids with the epitope.

Those amino acid locations demonstrating functional sensitivity to the substitutions then are refined by introducing further or other variants at, or for, the sites of substitution. Thus, while the site for introducing an amino acid sequence variation is predetermined, the nature of the mutation per se needs not to be predetermined. For example, to analyze the performance of a mutation at a given site, ala scanning or random mutagenesis is conducted at a target codon or region and the expressed antibody construct variants are screened for the desired activity.

Preferably, amino acid sequence insertions include amino- and/or carboxyl-terminal fusions ranging in length from 1, 2, 3, 4, 5, 6, 7, 8, 9 or 10 residues to polypeptides containing a hundred or more residues, as well as intrasequence insertions of single or multiple amino acid residues. An insertional variant of the antibody construct includes the fusion to the N- or C-terminus of the antibody to an enzyme or a fusion to a polypeptide which increases the serum half-life of the antibody.

Another type of variant is an amino acid substitution variant. These variants have preferably at least 1, 2, 3, 4, 5, 6, 7, 8, 9 or 10 amino acid residues in the antibody construct replaced by a different residue. The sites of greatest interest for substitutional mutagenesis include the CDRs of the heavy and/or light chain, in particular the hypervariable regions, but FR alterations in the heavy and/or light chain are also contemplated.

For example, if a CDR sequence encompasses 6 amino acids, it is envisaged that one, two or three of these amino acids are substituted. Similarly, if a CDR sequence encompasses 15 amino acids it is envisaged that one, two, three, four, five or six of these amino acids are substituted.

Generally, if amino acids are substituted in one or more or all of the CDRs of the heavy and/or light chain, it is preferred that the then-obtained "substituted" sequence is at least 60%, more preferably 65%, even more preferably 70%, particularly preferably 75%, more particularly preferably 80% identical to the "original" CDR sequence. This means that it is dependent of the length of the CDR to which degree it is identical to the "substituted" sequence. For example, a CDR having 5 amino acids is preferably 80% identical to its substituted sequence in order to have at least one amino acid substituted. Accordingly, the CDRs of the antibody construct may have different degrees of identity to their substituted sequences, e.g., CDRL1 may have 80%, while CDRL3 may have 90%.

Preferred substitutions (or replacements) are conservative substitutions. However, any substitution (including non-conservative substitution or one or more from the "exemplary substitutions" listed in Table 1, below) is envisaged as long as the antibody construct retains its capability to bind to CDH19 via the first binding domain and to CD3 epsilon via the second binding domain and/or its CDRs have an identity to the then substituted sequence (at least 60%, more preferably 65%, even more preferably 70%, particularly preferably 75%, more particularly preferably 80% identical to the "original" CDR sequence).

Conservative substitutions are shown in Table 1 under the heading of "preferred substitutions". If such substitutions result in a change in biological activity, then more substantial changes, denominated "exemplary substitutions" in Table 1, or as further described below in reference to amino acid classes, may be introduced and the products screened for a desired characteristic.

TABLE 1

Amino Acid Substitutions

| Original | Exemplary Substitutions | Preferred Substitutions |
|---|---|---|
| Ala (A) | val, leu, ile | val |
| Arg (R) | lys, gln, asn | lys |
| Asn (N) | gln, his, asp, lys, arg | gln |
| Asp (D) | glu, asn | glu |
| Cys (C) | ser, ala | ser |
| Gln (Q) | asn, glu | asn |
| Glu (E) | asp, gln | asp |
| Gly (G) | ala | ala |
| His (H) | asn, gln, lys, arg | arg |
| Ile (I) | leu, val, met, ala, phe | leu |
| Leu (L) | norleucine, ile, val, met, ala | ile |
| Lys (K) | arg, gln, asn | arg |
| Met (M) | leu, phe, ile | leu |
| Phe (F) | leu, val, ile, ala, tyr | tyr |
| Pro (P) | ala | ala |
| Ser (S) | thr | thr |
| Thr (T) | ser | ser |
| Trp (W) | tyr, phe | tyr |
| Tyr (Y) | trp, phe, thr, ser | phe |
| Val (V) | ile, leu, met, phe, ala | leu |

Substantial modifications in the biological properties of the antibody construct of the present invention are accomplished by selecting substitutions that differ significantly in their effect on maintaining (a) the structure of the polypeptide backbone in the area of the substitution, for example, as a sheet or helical conformation, (b) the charge or hydrophobicity of the molecule at the target site, or (c) the bulk of the side chain. Naturally occurring residues are divided into groups based on common side-chain properties: (1) hydrophobic: norleucine, met, ala, val, leu, ile; (2) neutral hydrophilic: cys, ser, thr; (3) acidic: asp, glu; (4) basic: asn, gin, his, lys, arg; (5) residues that influence chain orientation: gly, pro; and (6) aromatic: trp, tyr, phe.

Non-conservative substitutions will entail exchanging a member of one of these classes for another class. Any cysteine residue not involved in maintaining the proper conformation of the antibody construct may be substituted, generally with serine, to improve the oxidative stability of the molecule and prevent aberrant crosslinking. Conversely, cysteine bond(s) may be added to the antibody to improve its stability (particularly where the antibody is an antibody fragment such as an Fv fragment).

A particularly preferred type of substitutional variant involves substituting one or more hypervariable region residues of a parent antibody (e. g. a humanized or human antibody). Generally, the resulting variant(s) selected for further development will have improved biological properties relative to the parent antibody from which they are generated. A convenient way for generating such substitutional variants involves affinity maturation using phage display. Briefly, several hypervariable region sites (e. g. 6-7 sites) are mutated to generate all possible amino acid substitutions at each site. The antibody variants thus generated are displayed in a monovalent fashion from filamentous phage particles as fusions to the gene III product of M13 packaged within each particle. The phage-displayed variants are then screened for their biological activity (e. g. binding affinity) as herein disclosed. In order to identify candidate hypervariable region sites for modification, alanine scanning mutagenesis can be performed to identify hypervariable region residues contributing significantly to antigen binding. Alternatively, or additionally, it may be beneficial to analyze a crystal structure of the antigen-antibody complex to identify contact points between the binding domain and, e.g., human CDH19. Such contact residues and neighbouring residues are candidates for substitution according to the techniques elaborated herein. Once such variants are generated, the panel of variants is subjected to screening as described herein and antibodies with superior properties in one or more relevant assays may be selected for further development.

Other modifications of the antibody construct are contemplated herein. For example, the antibody construct may be linked to one of a variety of non-proteinaceous polymers, e.g., polyethylene glycol, polypropylene glycol, polyoxyalkylenes, or copolymers of polyethylene glycol and polypropylene glycol. The antibody construct may also be entrapped in microcapsules prepared, for example, by coacervation techniques or by interfacial polymerization (for example, hydroxymethylcellulose or gelatine-microcapsules and poly(methylmethacylate) microcapsules, respectively), in colloidal drug delivery systems (for example, liposomes, albumin microspheres, microemulsions, nanoparticles and nanocapsules), or in macroemulsions. Such techniques are disclosed in Remington's Pharmaceutical Sciences, 16th edition, Oslo, A., Ed., (1980).

The antibody constructs disclosed herein may also be formulated as immuno-liposomes. A "liposome" is a small vesicle composed of various types of lipids, phospholipids and/or surfactant which is useful for delivery of a drug to a mammal. The components of the liposome are commonly arranged in a bilayer formation, similar to the lipid arrangement of biological membranes. Liposomes containing the antibody are prepared by methods known in the art, such as described in Epstein et al., Proc. Natl. Acad. Sci. USA, 82: 3688 (1985); Hwang et al., Proc. Natl Acad. Sci. USA, 77: 4030 (1980); U.S. Pat. Nos. 4,485,045 and 4,544,545; and WO 97/38731 published Oct. 23, 1997. Liposomes with enhanced circulation time are disclosed in U.S. Pat. No. 5,013,556. Particularly useful liposomes can be generated by the reverse phase evaporation method with a lipid composition comprising phosphatidylcholine, cholesterol and PEG-derivatized phosphatidylethanolamine (PEG-PE). Liposomes are extruded through filters of defined pore size to yield liposomes with the desired diameter. Fab' fragments of the antibody of the present invention can be conjugated to the liposomes as described in Martin et al. J. Biol. Chem. 257: 286-288 (1982) via a disulfide interchange reaction. A chemotherapeutic agent is optionally contained within the liposome. See Gabizon et al. J. National Cancer Inst. 81 (19) 1484 (1989).

When using recombinant techniques, the antibody construct can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli.

The antibody construct composition prepared from the cells can be purified using, for example, hydroxylapatite chromatography, gel electrophoresis, dialysis, and affinity chromatography, with affinity chromatography being the preferred purification technique.

The term "nucleic acid" is well known to the skilled person and encompasses DNA (such as cDNA) and RNA (such as mRNA). The nucleic acid can be double stranded and single stranded, linear and circular. Said nucleic acid molecule is preferably comprised in a vector which is preferably comprised in a host cell. Said host cell is, e.g. after transformation or transfection with the nucleic acid sequence of the invention, capable of expressing the antibody construct. For that purpose the nucleic acid molecule is operatively linked with control sequences.

A vector is a nucleic acid molecule used as a vehicle to transfer (foreign) genetic material into a cell. The term "vector" encompasses—but is not restricted to—plasmids, viruses, cosmids and artificial chromosomes. In general, engineered vectors comprise an origin of replication, a multicloning site and a selectable marker. The vector itself is generally a nucleotide sequence, commonly a DNA sequence, that comprises an insert (transgene) and a larger sequence that serves as the "backbone" of the vector. Modern vectors may encompass additional features besides the transgene insert and a backbone: promoter, genetic marker, antibiotic resistance, reporter gene, targeting sequence, protein purification tag. Vectors called expression vectors (expression constructs) specifically are for the expression of the transgene in the target cell, and generally have control sequences such as a promoter sequence that drives expression of the transgene. Insertion of a vector into the target cell is usually called "transformation" for bacteria, "transfection" for eukaryotic cells, although insertion of a viral vector is also called "transduction".

As used herein, the term "host cell" is intended to refer to a cell into which a nucleic acid encoding the antibody construct of the invention is introduced by way of transformation, transfection and the like. It should be understood that such terms refer not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

As used herein, the term "expression" includes any step involved in the production of a antibody construct of the invention including, but not limited to, transcription, post-transcriptional modification, translation, post-translational modification, and secretion.

The term "control sequences" refers to DNA sequences necessary for the expression of an operably linked coding sequence in a particular host organism. The control sequences that are suitable for prokaryotes, for example, include a promoter, optionally an operator sequence, and a ribosome binding site. Eukaryotic cells are known to utilize promoters, polyadenylation signals, and enhancers.

A nucleic acid is "operably linked" when it is placed into a functional relationship with another nucleic acid sequence. For example, DNA for a presequence or secretory leader is operably linked to DNA for a polypeptide if it is expressed as a preprotein that participates in the secretion of the polypeptide; a promoter or enhancer is operably linked to a coding sequence if it affects the transcription of the sequence; or a ribosome binding site is operably linked to a coding sequence if it is positioned so as to facilitate translation. Generally, "operably linked" means that the DNA sequences being linked are contiguous, and, in the case of a secretory leader, contiguous and in reading phase. However, enhancers do not have to be contiguous. Linking is accomplished by ligation at convenient restriction sites. If such sites do not exist, the synthetic oligonucleotide adaptors or linkers are used in accordance with conventional practice.

The terms "host cell," "target cell" or "recipient cell" are intended to include any individual cell or cell culture that can be or has/have been recipients for vectors or the incorporation of exogenous nucleic acid molecules, polynucleotides and/or proteins. It also is intended to include progeny of a single cell, and the progeny may not necessarily be completely identical (in morphology or in genomic or total DNA complement) to the original parent cell due to natural, accidental, or deliberate mutation. The cells may be prokaryotic or eukaryotic, and include but are not limited to bacteria, yeast cells, animal cells, and mammalian cells, e.g., murine, rat, macaque or human.

Suitable host cells include prokaryotes and eukaryotic host cells including yeasts, fungi, insect cells and mammalian cells.

The antibody construct of the invention can be produced in bacteria. After expression, the antibody construct of the invention, preferably the antibody construct is isolated from the E. coli cell paste in a soluble fraction and can be purified through, e.g., affinity chromatography and/or size exclusion. Final purification can be carried out similar to the process for purifying antibody expressed e. g, in CHO cells.

In addition to prokaryotes, eukaryotic microbes such as filamentous fungi or yeast are suitable cloning or expression hosts for the antibody construct of the invention. Saccharomyces cerevisiae, or common baker's yeast, is the most commonly used among lower eukaryotic host microorganisms. However, a number of other genera, species, and strains are commonly available and useful herein, such as Schizosaccharomyces pombe, Kluyveromyces hosts such as, e.g., K. lactis, K. fragilis (ATCC 12424), K. bulgaricus (ATCC 16045), K. wickeramii (ATCC 24178), K. waltii (ATCC 56500), K. drosophilarum (ATCC 36906), K. thermotolerans, and K. marxianus; yarrowia (EP 402 226); Pichia pastoris (EP 183 070); Candida; Trichoderma reesia (EP 244 234); Neurospora crassa; Schwanniomyces such as Schwanniomyces occidentalis; and filamentous fungi such as, e.g., Neurospora, Penicillium, Tolypocladium, and Aspergillus hosts such as A. nidulans and A. niger.

Suitable host cells for the expression of glycosylated antibody construct of the invention, preferably antibody derived antibody constructs are derived from multicellular organisms. Examples of invertebrate cells include plant and insect cells. Numerous baculoviral strains and variants and corresponding permissive insect host cells from hosts such as Spodoptera frugiperda (caterpillar), Aedes aegypti (mosquito), Aedes albopictus (mosquito), Drosophila melanogaster (fruit fly), and Bombyx mori have been identified. A variety of viral strains for transfection are publicly available, e. g., the L-1 variant of Autographa californica NPV and the Bm-5 strain of Bombyx mori NPV, and such viruses may be used as the virus herein according to the present invention, particularly for transfection of Spodoptera frugiperda cells.

Plant cell cultures of cotton, corn, potato, soybean, petunia, tomato, Arabidopsis and tobacco can also be utilized as hosts. Cloning and expression vectors useful in the production of proteins in plant cell culture are known to those of skill in the art. See e.g. Hiatt et al., Nature (1989) 342: 76-78, Owen et al. (1992) Bio/Technology 10: 790-794, Artsaenko et al. (1995) The Plant J 8: 745-750, and Fecker et al. (1996) Plant Mol Biol 32: 979-986.

However, interest has been greatest in vertebrate cells, and propagation of vertebrate cells in culture (tissue culture) has become a routine procedure. Examples of useful mammalian host cell lines are monkey kidney CV1 line transformed by SV40 (COS-7, ATCC CRL 1651); human embryonic kidney line (293 or 293 cells subcloned for growth in suspension culture, Graham et al., J. Gen Virol. 36: 59 (1977)); baby hamster kidney cells (BHK, ATCC CCL 10); Chinese hamster ovary cells/-DHFR (CHO, Urlaub et al., Proc. Natl. Acad. Sci. USA 77: 4216 (1980)); mouse sertoli cells (TM4, Mather, Biol. Reprod. 23: 243-251 (1980)); monkey kidney cells (CVI ATCC CCL 70); African green monkey kidney cells (VERO-76, ATCC CRL1587); human cervical carcinoma cells (HELA, ATCC CCL 2); canine kidney cells (MDCK, ATCC CCL 34); buffalo rat liver cells (BRL 3A, ATCC CRL 1442); human lung cells (W138, ATCC CCL 75); human liver cells (Hep G2,1413 8065); mouse mammary tumor (MMT 060562, ATCC CCL5 1); TRI cells (Mather et al., Annals N. Y Acad. Sci. 383: 44-68 (1982)); MRC 5 cells; FS4 cells; and a human hepatoma line (Hep G2).

When using recombinant techniques, the antibody construct of the invention can be produced intracellularly, in the periplasmic space, or directly secreted into the medium. If the antibody construct is produced intracellularly, as a first step, the particulate debris, either host cells or lysed fragments, are removed, for example, by centrifugation or ultrafiltration. Carter et al., Bio/Technology 10: 163-167 (1992) describe a procedure for isolating antibodies which are secreted to the periplasmic space of E. coli. Briefly, cell paste is thawed in the presence of sodium acetate (pH 3.5), EDTA, and phenylmethylsulfonylfluoride (PMSF) over about 30 min. Cell debris can be removed by centrifugation. Where the antibody is secreted into the medium, supernatants from such expression systems are generally first concentrated using a commercially available protein concentration filter, for example, an Amicon or Millipore Pellicon ultrafiltration unit. A protease inhibitor such as PMSF may be included in any of the foregoing steps to inhibit proteolysis and antibiotics may be included to prevent the growth of adventitious contaminants.

The antibody construct of the invention prepared from the host cells can be purified using, for example, hydroxylapatite chromatography, gel electrophoresis, dialysis, and affinity chromatography, with affinity chromatography being the preferred purification technique.

The matrix to which the affinity ligand is attached is most often agarose, but other matrices are available. Mechanically stable matrices such as controlled pore glass or poly(styrenedivinyl)benzene allow for faster flow rates and shorter processing times than can be achieved with agarose. Where the antibody construct of the invention comprises a CH3 domain, the Bakerbond ABXMresin (J. T. Baker, Phillipsburg, N.J.) is useful for purification. Other techniques for protein purification such as fractionation on an ion-exchange column, ethanol precipitation, Reverse Phase HPLC, chromatography on silica, chromatography on heparin SEPHAROSE™ chromatography on an anion or cation exchange resin (such as a polyaspartic acid column), chromato-focusing, SDS-PAGE, and ammonium sulfate precipitation are also available depending on the antibody to be recovered.

The term "culturing" refers to the in vitro maintenance, differentiation, growth, proliferation and/or propagation of cells under suitable conditions in a medium.

As used herein, the term "pharmaceutical composition" relates to a composition for administration to a patient, preferably a human patient. The particular preferred pharmaceutical composition of this invention comprises the antibody construct of the invention. Preferably, the pharmaceutical composition comprises suitable formulations of carriers, stabilizers and/or excipients. In a preferred embodiment, the pharmaceutical composition comprises a composition for parenteral, transdermal, intraluminal, intraarterial, intrathecal and/or intranasal administration or by direct injection into tissue. It is in particular envisaged that said composition is administered to a patient via infusion or injection. Administration of the suitable compositions may be effected by different ways, e.g., by intravenous, intraperitoneal, subcutaneous, intramuscular, topical or intradermal administration. In particular, the present invention provides for an uninterrupted administration of the suitable composition. As a non-limiting example, uninterrupted, i.e. continuous administration may be realized by a small pump system worn by the patient for metering the influx of therapeutic agent into the body of the patient. The pharmaceutical composition comprising the antibody construct of the invention can be administered by using said pump systems. Such pump systems are generally known in the art, and commonly rely on periodic exchange of cartridges containing the therapeutic agent to be infused. When exchanging the cartridge in such a pump system, a temporary interruption of the otherwise uninterrupted flow of therapeutic agent into the body of the patient may ensue. In such a case, the phase of administration prior to cartridge replacement and the phase of administration following cartridge replacement would still be considered within the meaning of the pharmaceutical means and methods of the invention together make up one "uninterrupted administration" of such therapeutic agent.

The continuous or uninterrupted administration of these antibody constructs of the invention may be intravenous or subcutaneous by way of a fluid delivery device or small pump system including a fluid driving mechanism for driving fluid out of a reservoir and an actuating mechanism for actuating the driving mechanism. Pump systems for subcutaneous administration may include a needle or a cannula for penetrating the skin of a patient and delivering the suitable composition into the patient's body. Said pump systems may be directly fixed or attached to the skin of the patient independently of a vein, artery or blood vessel, thereby allowing a direct contact between the pump system and the skin of the patient. The pump system can be attached to the skin of the patient for 24 hours up to several days. The pump system may be of small size with a reservoir for small volumes. As a non-limiting example, the volume of the reservoir for the suitable pharmaceutical composition to be administered can be between 0.1 and 50 ml.

The continuous administration may be transdermal by way of a patch worn on the skin and replaced at intervals. One of skill in the art is aware of patch systems for drug delivery suitable for this purpose. It is of note that transdermal administration is especially amenable to uninterrupted administration, as exchange of a first exhausted patch can advantageously be accomplished simultaneously with the placement of a new, second patch, for example on the surface of the skin immediately adjacent to the first exhausted patch and immediately prior to removal of the first exhausted patch. Issues of flow interruption or power cell failure do not arise.

The inventive compositions may further comprise a pharmaceutically acceptable carrier. Examples of suitable pharmaceutical carriers are well known in the art and include solutions, e.g. phosphate buffered saline solutions, water, emulsions, such as oil/water emulsions, various types of wetting agents, sterile solutions, liposomes, etc. Compositions comprising such carriers can be formulated by well known conventional methods. Formulations can comprise carbohydrates, buffer solutions, amino acids and/or surfactants. Carbohydrates may be non-reducing sugars, preferably trehalose, sucrose, octasulfate, sorbitol or xylitol. In general, as used herein, "pharmaceutically acceptable carrier" means any and all solvents, dispersion media, coatings, antibacterial and antifungal agents, isotonic and absorption delaying agents, compatible with pharmaceutical administration. The use of such media and agents for pharmaceutically active substances is well known in the art. Acceptable carriers, excipients, or stabilizers are nontoxic to recipients at the dosages and concentrations employed and include: additional buffering agents; preservatives; co-solvents; antioxidants, including ascorbic acid and methionine; chelating agents such as EDTA; metal complexes (e.g., Zn-protein complexes); biodegradable polymers, such as polyesters; salt-forming counter-ions, such as sodium, polyhydric sugar alcohols; amino acids, such as alanine, glycine, asparagine, 2-phenylalanine, and threonine; sugars or sugar alcohols, such as trehalose, sucrose, octasulfate, sorbitol or xylitol stachyose, mannose, sorbose, xylose, ribose, myoinisitose, galactose, lactitol, ribitol, myoinisitol, galactitol, glycerol, cyclitols (e.g., inositol), polyethylene glycol; sulfur containing reducing agents, such as glutathione, thioctic acid, sodium thioglycolate, thioglycerol, [alpha]-monothioglycerol, and sodium thio sulfate; low molecular weight proteins, such as human serum albumin, bovine serum albumin, gelatin, or other immunoglobulins; and hydrophilic polymers, such as polyvinylpyrrolidone. Such formulations may be used for continuous administrations which may be intravenuous or subcutaneous with and/or without pump systems. Amino acids may be charged amino acids, preferably lysine, lysine acetate, arginine, glutamate and/or histidine. Surfactants may be detergents, preferably with a molecular weight of >1.2 KD and/or a polyether, preferably with a molecular weight of >3 KD. Non-limiting examples for preferred detergents are Tween 20, Tween 40, Tween 60, Tween 80 or Tween 85. Non-limiting examples for preferred polyethers are PEG 3000, PEG 3350, PEG 4000 or PEG 5000. Buffer systems used in the present invention can have a preferred pH of 5-9 and may comprise citrate, succinate, phosphate, histidine and acetate.

The compositions of the present invention can be administered to the subject at a suitable dose which can be determined e.g. by dose escalating studies by administration of increasing doses of the polypeptide of the invention exhibiting cross-species specificity described herein to non-chimpanzee primates, for instance macaques. As set forth above, the antibody construct of the invention exhibiting cross-species specificity described herein can be advantageously used in identical form in preclinical testing in non-chimpanzee primates and as drug in humans. These compositions can also be administered in combination with other proteinaceous and non-proteinaceous drugs. These drugs may be administered simultaneously with the composition comprising the polypeptide of the invention as defined herein or separately before or after administration of said polypeptide in timely defined intervals and doses. The dosage regimen will be determined by the attending physician and clinical factors. As is well known in the medical arts, dosages for any one patient depend upon many factors, including the patient's size, body surface area, age, the particular compound to be administered, sex, time and route of administration, general health, and other drugs being administered concurrently.

Preparations for parenteral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include water, alcoholic/aqueous solutions, emulsions or suspensions, including saline and buffered media. Parenteral vehicles include sodium chloride solution, Ringer's dextrose, dextrose and sodium chloride, lactated Ringer's, or fixed oils. Intravenous vehicles include fluid and nutrient replenishers, electrolyte replenishers (such as those based on Ringer's dextrose), and the like. Preservatives and other additives may also be present such as, for example, antimicrobials, anti-oxidants, chelating agents, inert gases and the like. In addition, the composition of the present invention might comprise proteinaceous carriers, like, e.g., serum albumin or immunoglobulin, preferably of human origin. It is envisaged that the composition of the invention might comprise, in addition to the polypeptide of the invention defined herein, further biologically active agents, depending on the intended use of the composition. Such agents might be drugs acting on the gastro-intestinal system, drugs acting as cytostatica, drugs preventing hyperurikemia, drugs inhibiting immunoreactions (e.g. corticosteroids), drugs modulating the inflammatory response, drugs acting on the circulatory system and/or agents such as cytokines known in the art. It is also envisaged that the antibody construct of the present invention is applied in a co-therapy, i.e., in combination with another anti-cancer medicament.

The biological activity of the pharmaceutical composition defined herein can be determined for instance by cytotoxicity assays, as described in the following examples, in WO 99/54440 or by Schlereth et al. (Cancer Immunol. Immunother. 20 (2005), 1-12). "Efficacy" or "in vivo efficacy" as used herein refers to the response to therapy by the pharmaceutical composition of the invention, using e.g. standardized NCI response criteria. The success or in vivo efficacy of the therapy using a pharmaceutical composition of the invention refers to the effectiveness of the composition for its intended purpose, i.e. the ability of the composition to cause its desired effect, i.e. depletion of pathologic cells, e.g. tumor cells. The in vivo efficacy may be monitored by established standard methods for the respective disease entities including, but not limited to white blood cell counts, differentials, Fluorescence Activated Cell Sorting, bone marrow aspiration. In addition, various disease specific clinical chemistry parameters and other established standard methods may be used. Furthermore, computer-aided tomography, X-ray, nuclear magnetic resonance tomography (e.g. for National Cancer Institute-criteria based response assessment [Cheson B D, Horning S J, Coiffier B, Shipp M A, Fisher R I, Connors J M, Lister T A, Vose J, Grillo-Lopez A, Hagenbeek A, Cabanillas F, Klippensten D, Hiddemann W, Castellino R, Harris N L, Armitage J O, Carter W, Hoppe R, Canellos G P. Report of an international workshop to standardize response criteria for non-Hodgkin's lymphomas. NCI Sponsored International Working Group. J Clin Oncol. 1999 April; 17(4):1244]), positron-emission tomography scanning, white blood cell counts, differentials, Fluorescence Activated Cell Sorting, bone marrow aspiration, lymph node biopsies/histologies, and various lymphoma specific clinical chemistry parameters (e.g. lactate dehydrogenase) and other established standard methods may be used.

Another major challenge in the development of drugs such as the pharmaceutical composition of the invention is the predictable modulation of pharmacokinetic properties. To this end, a pharmacokinetic profile of the drug candidate, i.e. a profile of the pharmacokinetic parameters that affect the ability of a particular drug to treat a given condition, can be established. Pharmacokinetic parameters of the drug influencing the ability of a drug for treating a certain disease entity include, but are not limited to: half-life, volume of distribution, hepatic first-pass metabolism and the degree of blood serum binding. The efficacy of a given drug agent can be influenced by each of the parameters mentioned above.

"Half-life" means the time where 50% of an administered drug are eliminated through biological processes, e.g. metabolism, excretion, etc.

By "hepatic first-pass metabolism" is meant the propensity of a drug to be metabolized upon first contact with the liver, i.e. during its first pass through the liver.

"Volume of distribution" means the degree of retention of a drug throughout the various compartments of the body, like e.g. intracellular and extracellular spaces, tissues and organs, etc. and the distribution of the drug within these compartments.

"Degree of blood serum binding" means the propensity of a drug to interact with and bind to blood serum proteins, such as albumin, leading to a reduction or loss of biological activity of the drug.

Pharmacokinetic parameters also include bioavailability, lag time (Tlag), Tmax, absorption rates, more onset and/or Cmax for a given amount of drug administered. "Bioavailability" means the amount of a drug in the blood compartment. "Lag time" means the time delay between the administration of the drug and its detection and measurability in blood or plasma.

"Tmax" is the time after which maximal blood concentration of the drug is reached, and "Cmax" is the blood concentration maximally obtained with a given drug. The time to reach a blood or tissue concentration of the drug which is required for its biological effect is influenced by all parameters. Pharmacokinetic parameters of bispecific single chain antibodies exhibiting cross-species specificity, which may be determined in preclinical animal testing in non-chimpanzee primates as outlined above, are also set forth e.g. in the publication by Schlereth et al. (Cancer Immunol. Immunother. 20 (2005), 1-12).

The term "toxicity" as used herein refers to the toxic effects of a drug manifested in adverse events or severe adverse events. These side events might refer to a lack of tolerability of the drug in general and/or a lack of local tolerance after administration. Toxicity could also include teratogenic or carcinogenic effects caused by the drug.

The term "safety", "in vivo safety" or "tolerability" as used herein defines the administration of a drug without inducing severe adverse events directly after administration (local tolerance) and during a longer period of application of the drug. "Safety", "in vivo safety" or "tolerability" can be evaluated e.g. at regular intervals during the treatment and follow-up period. Measurements include clinical evaluation, e.g. organ manifestations, and screening of laboratory abnormalities. Clinical evaluation may be carried out and deviations to normal findings recorded/coded according to NCI-CTC and/or MedDRA standards. Organ manifestations may include criteria such as allergy/immunology, blood/bone marrow, cardiac arrhythmia, coagulation and the like, as set forth e.g. in the Common Terminology Criteria for adverse events v3.0 (CTCAE). Laboratory parameters which may be tested include for instance hematology, clinical chemistry, coagulation profile and urine analysis and examination of other body fluids such as serum, plasma, lymphoid or spinal fluid, liquor and the like. Safety can thus be assessed e.g. by physical examination, imaging techniques (i.e. ultrasound, x-ray, CT scans, Magnetic Resonance Imaging (MRI), other measures with technical devices (i.e. electrocardiogram), vital signs, by measuring laboratory parameters and recording adverse events. For example, adverse events in non-chimpanzee primates in the uses and methods according to the invention may be examined by histopathological and/or histochemical methods.

The term "effective dose" or "effective dosage" is defined as an amount sufficient to achieve or at least partially achieve the desired effect. The term "therapeutically effective dose" is defined as an amount sufficient to cure or at least partially arrest the disease and its complications in a patient already suffering from the disease. Amounts effective for this use will depend upon the severity of the infection and the general state of the subject's own immune system. The term "patient" includes human and other mammalian subjects that receive either prophylactic or therapeutic treatment.

The term "effective and non-toxic dose" as used herein refers to a tolerable dose of an inventive antibody construct which is high enough to cause depletion of pathologic cells, tumor elimination, tumor shrinkage or stabilization of disease without or essentially without major toxic effects. Such effective and non-toxic doses may be determined e.g. by dose escalation studies described in the art and should be below the dose inducing severe adverse side events (dose limiting toxicity, DLT).

The above terms are also referred to e.g. in the Preclinical safety evaluation of biotechnology-derived pharmaceuticals S6; ICH Harmonised Tripartite Guideline; ICH Steering Committee meeting on Jul. 16, 1997.

The appropriate dosage, or therapeutically effective amount, of the antibody construct of the invention will depend on the condition to be treated, the severity of the condition, prior therapy, and the patient's clinical history and response to the therapeutic agent. The proper dose can be adjusted according to the judgment of the attending physician such that it can be administered to the patient one time or over a series of administrations. The pharmaceutical composition can be administered as a sole therapeutic or in combination with additional therapies such as anti-cancer therapies as needed.

The pharmaceutical compositions of this invention are particularly useful for parenteral administration, i.e., subcutaneously, intramuscularly, intravenously, intra-articular and/or intra-synovial. Parenteral administration can be by bolus injection or continuous infusion.

If the pharmaceutical composition has been lyophilized, the lyophilized material is first reconstituted in an appropriate liquid prior to administration. The lyophilized material may be reconstituted in, e.g., bacteriostatic water for injection (BWFI), physiological saline, phosphate buffered saline (PBS), or the same formulation the protein had been in prior to lyophilization.

In an internal analysis of proprietary mRNA expression data it has been surprisingly found that CDH19 expression is elevated in both primary and metastatic melanoma tumors compared to normal, untransformed tissues. Internal analysis also confirmed that expression of CDH19 in normal tissues is limited to neural crest derived peripheral nerve ganglia and nerve fibers. The differential CDH19 expression in normal and tumor tissues makes this protein attractive for cell-surface targeting therapeutics. Although CDH 19 was discussed as one marker as part of long lists of markers associated with some cancer types (see e.g. WO2009/055937) or Parkinson's disease (see e.g. WO2005/067391) CDH19 was never discussed as a prognostic marker or a drug target in connection with melanoma tumors.

As stated above, the present invention provides an isolated multispecific antibody construct comprising a first human binding domain capable of binding to human CDH19 on the surface of a target cell and a second domain capable of binding to human CD3 on the surface of a T cell.

The "CDH19 extracellular domain" or "CDH19 ECD" refers to a form of CDH19 which is essentially free of transmembrane and cytoplasmic domains of CDH19. It will be understood by the skilled artisan that the transmembrane domain identified for the CDH19 polypeptide of the present invention is identified pursuant to criteria routinely employed in the art for identifying that type of hydrophobic domain. The exact boundaries of a transmembrane domain may vary but most likely by no more than about 5 amino acids at either end of the domain specifically mentioned herein. A preferred human CDH19 ECD is shown in SEQ ID NO: 948. In this context it is understood that the CDH19 ECD represents the part of CDH19 on the surface of a target cell.

The T cell CD3 receptor complex is a protein complex and is composed of four distinct chains. In mammals, the complex contains a CD3γ chain, a CD3δ chain, and two CD3ε (epsilon) chains. These chains associate with a molecule known as the T cell receptor (TCR) and the ζ chain to generate an activation signal in T lymphocytes.

The redirected lysis of target cells via the recruitment of T cells by a multispecific, at least bispecific, antibody construct involves cytolytic synapse formation and delivery of perforin and granzymes. The engaged T cells are capable of serial target cell lysis, and are not affected by immune escape mechanisms interfering with peptide antigen processing and presentation, or clonal T cell differentiation; see, for example, WO 2007/042261.

The affinity of the first binding domain for human CDH19 is preferably ≤15 nM, more preferably ≤10 nM, even more preferably ≤5 nM, even more preferably ≤1 nM, even more preferably ≤0.5 nM, even more preferably ≤50.1 nM, and most preferably ≤0.05 nM. The affinity of the first binding domain for macaque CDH19 is preferably ≤15 nM, more preferably ≤10 nM, even more preferably ≤5 nM, even more preferably ≤1 nM, even more preferably ≤0.5 nM, even more preferably ≤0.1 nM, and most preferably ≤0.05 nM or even ≤0.01 nM.

The affinity can be measured for example in a Biacore assay or in a Scatchard assay, e.g. as described in the Examples. The affinity gap for binding to macaque CDH19 versus human CDH19 is preferably [1:10-1:5] or [5:1-10:1], more preferably [1:5-5:1], and most preferably [1:2-3:1] or even [1:1-3:1]. Other methods of determining the affinity are well-known to the skilled person.

Human antibodies, respectively human antibody constructs, avoid some of the problems associated with antibodies/antibody constructs that possess murine or rat variable and/or constant regions. The presence of such murine or rat derived proteins can lead to the rapid clearance of the antibodies/antibody constructs or can lead to the generation of an immune response against the antibody/antibody construct by a patient. In order to avoid the utilization of murine or rat derived antibodies/antibody constructs, human or fully human antibodies can be generated through the introduction of human antibody function into a rodent so that the rodent produces fully human antibodies.

The ability to clone and reconstruct megabase-sized human loci in YACs and to introduce them into the mouse germline provides a powerful approach to elucidating the functional components of very large or crudely mapped loci as well as generating useful models of human disease. Furthermore, the utilization of such technology for substitution of mouse loci with their human equivalents could provide unique insights into the expression and regulation of human gene products during development, their communication with other systems, and their involvement in disease induction and progression.

An important practical application of such a strategy is the "humanization" of the mouse humoral immune system. Introduction of human immunoglobulin (Ig) loci into mice in which the endogenous Ig genes have been inactivated offers the opportunity to study the mechanisms underlying programmed expression and assembly of antibodies as well as their role in B-cell development. Furthermore, such a strategy could provide an ideal source for production of fully human monoclonal antibodies (mAbs)—an important milestone towards fulfilling the promise of antibody therapy in human disease. Fully human antibodies/antibody constructs are expected to minimize the immunogenic and allergic responses intrinsic to mouse or mouse-derivatized mAbs and thus to increase the efficacy and safety of the administered antibodies/antibody constructs. The use of fully human antibodies/antibody constructs can be expected to provide a substantial advantage in the treatment of chronic and recurring human diseases, such as inflammation, autoimmunity, and cancer, which require repeated compound administrations.

One approach towards this goal was to engineer mouse strains deficient in mouse antibody production with large fragments of the human Ig loci in anticipation that such mice would produce a large repertoire of human antibodies in the absence of mouse antibodies. Large human Ig fragments would preserve the large variable gene diversity as well as the proper regulation of antibody production and expression. By exploiting the mouse machinery for antibody diversification and selection and the lack of immunological tolerance to human proteins, the reproduced human antibody repertoire in these mouse strains should yield high affinity antibodies against any antigen of interest, including human antigens. Using the hybridoma technology, antigen-specific human mAbs with the desired specificity could be readily produced and selected. This general strategy was demonstrated in connection with our generation of the first Xeno-Mouse mouse strains, as published in 1994. (See Green et al. Nature Genetics 7:13-21 (1994)) The XenoMouse strains were engineered with yeast artificial chromosomes (YACs) containing 245 kb and 190 kb-sized germline configuration fragments of the human heavy chain locus and kappa light chain locus, respectively, which contained core variable and constant region sequences. Id. The human Ig containing YACs proved to be compatible with the mouse system for both rearrangement and expression of antibodies and were capable of substituting for the inactivated mouse Ig genes. This was demonstrated by their ability to induce B-cell development, to produce an adult-like human repertoire of fully human antibodies, and to generate antigen-specific human mAbs. These results also suggested that introduction of larger portions of the human Ig loci containing greater numbers of V genes, additional regulatory elements, and human Ig constant regions might recapitulate substantially the full repertoire that is characteristic of the human humoral response to infection and immunization. The work of Green et al. was recently extended to the introduction of greater than approximately 80% of the human antibody repertoire through introduction of megabase sized, germline configuration YAC fragments of the human heavy chain loci and kappa light chain loci, respectively. See Mendez et al. Nature Genetics 15:146-156 (1997) and U.S. patent application Ser. No. 08/759,620, filed Dec. 3, 1996, the disclosures of which are hereby incorporated by reference.

The production of the XenoMouse mice is further discussed and delineated in U.S. patent application Ser. No. 07/466,008, filed Jan. 12, 1990, Ser. No. 07/610,515, filed Nov. 8, 1990, Ser. No. 07/919,297, filed Jul. 24, 1992, Ser. No. 07/922,649, filed Jul. 30, 1992, filed Ser. No. 08/031,801, filed Mar. 15, 1993, Ser. No. 08/112,848, filed Aug. 27, 1993, Ser. No. 08/234,145, filed Apr. 28, 1994, Ser. No. 08/376,279, filed Jan. 20, 1995, Ser. No. 08/430,938, Apr. 27, 1995, Ser. No. 08/464,584, filed Jun. 5, 1995, Ser. No. 08/464,582, filed Jun. 5, 1995, Ser. No. 08/463,191, filed Jun. 5, 1995, Ser. No. 08/462,837, filed Jun. 5, 1995, Ser. No. 08/486,853, filed Jun. 5, 1995, Ser. No. 08/486,857, filed Jun. 5, 1995, Ser. No. 08/486,859, filed Jun. 5, 1995, Ser. No. 08/462,513, filed Jun. 5, 1995, Ser. No. 08/724,752, filed Oct. 2, 1996, and Ser. No. 08/759,620, filed Dec. 3, 1996 and U.S. Pat. Nos. 6,162,963, 6,150,584, 6,114,598, 6,075,181, and 5,939,598 and Japanese Patent Nos. 3 068 180 B2, 3 068 506 B2, and 3 068 507 B2. See also Mendez et al. Nature Genetics 15:146-156 (1997) and Green and Jakobovits J. Exp. Med. 188:483-495 (1998). See also European Patent No., EP 0 463151 B1, grant published Jun. 12, 1996, International Patent Application No., WO 94/02602, published Feb. 3, 1994, International Patent Application No., WO 96/34096, published Oct. 31, 1996, WO 98/24893, published Jun. 11, 1998, WO 00/76310, published Dec. 21, 2000, WO 03/47336. The disclosures of each of the above-cited patents, applications, and references are hereby incorporated by reference in their entirety.

In an alternative approach, others, including GenPharm International, Inc., have utilized a "minilocus" approach. In the minilocus approach, an exogenous Ig locus is mimicked through the inclusion of pieces (individual genes) from the Ig locus. Thus, one or more V.sub.H genes, one or more D.sub.H genes, one or more J.sub.H genes, a mu constant region, and a second constant region (preferably a gamma constant region) are formed into a construct for insertion into an animal. This approach is described in U.S. Pat. No. 5,545,807 to Surani et al. and U.S. Pat. Nos. 5,545,806, 5,625,825, 5,625,126, 5,633,425, 5,661,016, 5,770,429, 5,789,650, 5,814,318, 5,877,397, 5,874,299, and 6,255,458 each to Lonberg and Kay, U.S. Pat. Nos. 5,591,669 and 6,023.010 to Krimpenfort and Berns, U.S. Pat. Nos. 5,612,205, 5,721,367, and 5,789,215 to Berns et al., and U.S. Pat. No. 5,643,763 to Choi and Dunn, and GenPharm International U.S. patent application Ser. No. 07/574,748, filed Aug. 29, 1990, Ser. No. 07/575,962, filed Aug. 31, 1990, Ser. No. 07/810,279, filed Dec. 17, 1991, Ser. No. 07/853,408, filed Mar. 18, 1992, Ser. No. 07/904,068, filed Jun. 23, 1992, Ser. No. 07/990,860, filed Dec. 16, 1992, Ser. No. 08/053,131, filed Apr. 26, 1993, Ser. No. 08/096,762, filed Jul. 22, 1993, Ser. No. 08/155,301, filed Nov. 18, 1993, Ser. No. 08/161,739, filed Dec. 3, 1993, Ser. No. 08/165,699, filed Dec. 10, 1993, Ser. No. 08/209,741, filed Mar. 9, 1994, the disclosures of which are hereby incorporated by reference. See also European Patent No. 0 546 073 B1, International Patent Application Nos. WO 92/03918, WO 92/22645, WO 92/22647, WO 92/22670, WO 93/12227, WO 94/00569, WO 94/25585, WO 96/14436, WO 97/13852, and WO 98/24884 and U.S. Pat. No. 5,981,175, the disclosures of which are hereby incorporated by reference in their entirety. See further Taylor et al., 1992, Chen et al., 1993, Tuaillon et al., 1993, Choi et al., 1993, Lonberg et al., (1994), Taylor et al., (1994), and Tuaillon et al., (1995), Fishwild et al., (1996), the disclosures of which are hereby incorporated by reference in their entirety.

Kirin has also demonstrated the generation of human antibodies from mice in which, through microcell fusion, large pieces of chromosomes, or entire chromosomes, have been introduced. See European Patent Application Nos. 773 288 and 843 961, the disclosures of which are hereby incorporated by reference.Xenerex Biosciences is developing a technology for the potential generation of human antibodies. In this technology, SCID mice are reconstituted with human lymphatic cells, e.g., B and/or T cells. Mice are then immunized with an antigen and can generate an immune response against the antigen. See U.S. Pat. Nos. 5,476,996, 5,698,767, and 5,958,765.

Human anti-mouse antibody (HAMA) responses have led the industry to prepare chimeric or otherwise humanized antibodies. While chimeric antibodies have a human constant region and a murine variable region, it is expected that certain human anti-chimeric antibody (HACA) responses will be observed, particularly in chronic or multi-dose utilizations of the antibody. Thus, it would be desirable to provide fully human antibodies against EGFRvIII in order to vitiate concerns and/or effects of HAMA or HACA response.

Cytotoxicity mediated by CDH19/CD3 bispecific antibody constructs can be measured in various ways. Effector cells can be e.g. stimulated enriched (human) CD8 positive T cells or unstimulated (human) peripheral blood mononuclear cells (PBMC). If the target cells are of macaque origin or express or are transfected with macaque CDH19, the effector cells should also be of macaque origin such as a macaque T cell line, e.g. 4119LnPx. The target cells should express (at least the extracellular domain of) CDH19, e.g. human or macaque CDH19. Target cells can be a cell line (such as CHO) which is stably or transiently transfected with CDH19, e.g. human or macaque CDH19. Alternatively, the target cells can be a CDH19 positive natural expresser cell line, such as the human myeloma cell line CHL-1 or Colo-699. Usually EC50-values are expected to be lower with target cell lines expressing higher levels of CDH19 on the cell surface. The effector to target cell (E:T) ratio is usually about 10:1, but can also vary. Cytotoxic activity of CDH19/CD3 bispecific antibody constructs can be measured in an 51-chromium release assay (incubation time of about 18 hours) or in a in a FACS-based cytotoxicity assay (incubation time of about 48 hours). Modifications of the assay incubation time (cytotoxic reaction) are also possible. Other methods of measuring cytotoxicity are well-known to the skilled person and comprise MTT or MTS assays, ATP-based assays including bioluminescent assays, the sulforhodamine B (SRB) assay, WST assay, clonogenic assay and the ECIS technology.

The cytotoxic activity mediated by CDH19/CD3 bispecific antibody constructs of the present invention is preferably measured in a cell-based cytotoxicity assay. It is represented by the $EC_{50}$ value, which corresponds to the half maximal effective concentration (concentration of the antibody construct which induces a cytotoxic response halfway between the baseline and maximum). Preferably, the $EC_{50}$ value of the CDH19/CD3 bispecific antibody constructs is ≤20.000 pg/ml, more preferably ≤5000 pg/ml, even more preferably ≤1000 pg/ml, even more preferably ≤500 pg/ml, even more preferably ≤350 pg/ml, even more preferably ≤320 pg/ml, even more preferably ≤250 pg/ml, even more preferably ≤100 pg/ml, even more preferably ≤50 pg/ml, even more preferably ≤10 pg/ml, and most preferably ≤5 pg/ml.

Any of the above given $EC_{50}$ values can be combined with any one of the indicated scenarios of a cell-based cytotoxicity assay. For example, when (human) CD8 positive T cells or a macaque T cell line are used as effector cells, the $EC_{50}$ value of the CDH19/CD3 bispecific antibody construct is preferably ≤1000 pg/ml, more preferably ≤500 pg/ml, even more preferably ≤250 pg/ml, even more preferably ≤100 pg/ml, even more preferably ≤50 pg/ml, even more preferably ≤10 pg/ml, and most preferably ≤5 pg/ml. If in this assay the target cells are (human or macaque) CDH19 transfected cells such as CHO cells, the $EC_{50}$ value of the CDH19/CD3 bispecific antibody construct is preferably ≤150 pg/ml, more preferably ≤100 pg/ml, even more preferably ≤50 pg/ml, even more preferably ≤30 pg/ml, even more preferably ≤10 pg/ml, and most preferably ≤5 pg/ml.

If the target cells are a CDH19 positive natural expresser cell line, then the $EC_{50}$ value is preferably ≤350 pg/ml, more preferably ≤320 pg/ml, even more preferably ≤250 pg/ml, even more preferably ≤200 pg/ml, even more preferably ≤100 pg/ml, even more preferably ≤150 pg/ml, even more preferably ≤100 pg/ml, and most preferably ≤50 pg/ml, or lower.

When (human) PBMCs are used as effector cells, the $EC_{50}$ value of the CDH19/CD3 bispecific antibody construct is preferably ≤1000 pg/ml, more preferably ≤750 pg/ml, more preferably ≤500 pg/ml, even more preferably ≤350 pg/ml, even more preferably ≤320 pg/ml, even more preferably ≤250 pg/ml, even more preferably ≤100 pg/ml, and most preferably ≤50 pg/ml, or lower.

The difference in cytotoxic activity between the monomeric and the dimeric isoform of individual CDH19/CD3 bispecific antibody constructs is referred to as "potency gap". This potency gap can e.g. be calculated as ratio between $EC_{50}$ values of the molecule's monomeric and dimeric form. Potency gaps of the CDH19/CD3 bispecific antibody constructs of the present invention are preferably ≤5, more preferably ≤4, even more preferably ≤3, even more preferably ≤2 and most preferably ≤1.

The antibody construct of the invention is a fusion protein comprising at least two binding domains, with or without peptide linkers (spacer peptides). Among the suitable peptide linkers are those described in U.S. Pat. Nos. 4,751,180 and 4,935,233 or WO 88/09344.

Another method for preparing oligomeric antibody construct derivatives involves use of a leucine zipper. Leucine zipper domains are peptides that promote oligomerization of the proteins in which they are found. Leucine zippers were originally identified in several DNA-binding proteins (Landschulz et al., 1988, *Science* 240:1759), and have since been found in a variety of different proteins. Among the known leucine zippers are naturally occurring peptides and derivatives thereof that dimerize or trimerize. Examples of leucine zipper domains suitable for producing soluble oligomeric proteins are described in PCT application WO 94/10308, and the leucine zipper derived from lung surfactant protein D (SPD) described in Hoppe et al., 1994, *FEBS Letters* 344:191, hereby incorporated by reference. The use of a modified leucine zipper that allows for stable trimerization of a heterologous protein fused thereto is described in Fanslow et al., 1994, *Semin. Immunol.* 6:267-78. In one approach, recombinant fusion proteins comprising CDH19 antibody fragment or derivative fused to a leucine zipper peptide are expressed in suitable host cells, and the soluble oligomeric CDH19 antibody fragments or derivatives that form are recovered from the culture supernatant.

Covalent modifications of antigen binding proteins are included within the scope of this invention, and are generally, but not always, done post-translationally. For example, several types of covalent modifications of the antigen binding protein are introduced into the molecule by reacting specific amino acid residues of the antigen binding protein with an organic derivatizing agent that is capable of reacting with selected side chains or the N- or C-terminal residues.

Cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(5-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

Histidyl residues are derivatized by reaction with diethylpyrocarbonate at pH 5.5-7.0 because this agent is relatively specific for the histidyl side chain. Para-bromophenacyl bromide also is useful; the reaction is preferably performed in 0.1 M sodium cacodylate at pH 6.0. Lysinyl and amino terminal residues are reacted with succinic or other carboxylic acid anhydrides. Derivatization with these agents has the effect of reversing the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4-pentanedione; and transaminase-catalyzed reaction with glyoxylate.

Arginyl residues are modified by reaction with one or several conventional reagents, among them phenylglyoxal, 2,3-butanedione, 1,2-cyclohexanedione, and ninhydrin. Derivatization of arginine residues requires that the reaction be performed in alkaline conditions because of the high pKa of the guanidine functional group. Furthermore, these reagents may react with the groups of lysine as well as the arginine epsilon-amino group.

The specific modification of tyrosyl residues may be made, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively. Tyrosyl residues are iodinated using $^{125}I$ or $^{131}I$ to prepare labeled proteins for use in radioimmunoassay, the chloramine T method described above being suitable.

Carboxyl side groups (aspartyl or glutamyl) are selectively modified by reaction with carbodiimides (R'—N=C=N—R'), where R and R' are optionally different alkyl groups, such as 1-cyclohexyl-3-(2-morpholinyl-4-ethyl) carbodiimide or 1-ethyl-3-(4-azonia-4,4-dimethylpentyl) carbodiimide. Furthermore, aspartyl and glutamyl residues are converted to asparaginyl and glutaminyl residues by reaction with ammonium ions.

Derivatization with bifunctional agents is useful for crosslinking antigen binding proteins to a water-insoluble support matrix or surface for use in a variety of methods. Commonly used crosslinking agents include, e.g., 1,1-bis(diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Glutaminyl and asparaginyl residues are frequently deamidated to the corresponding glutamyl and aspartyl residues, respectively. Alternatively, these residues are deamidated under mildly acidic conditions. Either form of these residues falls within the scope of this invention.

Other modifications include hydroxylation of proline and lysine, phosphorylation of hydroxyl groups of seryl or threonyl residues, methylation of the α-amino groups of lysine, arginine, and histidine side chains (T. E. Creighton, Proteins: Structure and Molecular Properties, W. H. Freeman & Co., San Francisco, 1983, pp. 79-86), acetylation of the N-terminal amine, and amidation of any C-terminal carboxyl group.

Another type of covalent modification of the antigen binding protein included within the scope of this invention comprises altering the glycosylation pattern of the protein. As is known in the art, glycosylation patterns can depend on both the sequence of the protein (e.g., the presence or absence of particular glycosylation amino acid residues, discussed below), or the host cell or organism in which the protein is produced. Particular expression systems are discussed below.

Glycosylation of polypeptides is typically either N-linked or O-linked. N-linked refers to the attachment of the carbohydrate moiety to the side chain of an asparagine residue. The tri-peptide sequences asparagine-X-serine and asparagine-X-threonine, where X is any amino acid except proline, are the recognition sequences for enzymatic attachment of the carbohydrate moiety to the asparagine side chain. Thus, the presence of either of these tri-peptide sequences in a polypeptide creates a potential glycosylation site. O-linked glycosylation refers to the attachment of one of the sugars N-acetylgalactosamine, galactose, or xylose, to a hydroxyamino acid, most commonly serine or threonine, although 5-hydroxyproline or 5-hydroxylysine may also be used.

Addition of glycosylation sites to the antigen binding protein is conveniently accomplished by altering the amino acid sequence such that it contains one or more of the above-described tri-peptide sequences (for N-linked glycosylation sites). The alteration may also be made by the addition of, or substitution by, one or more serine or threonine residues to the starting sequence (for O-linked glycosylation sites). For ease, the antigen binding protein amino acid sequence is preferably altered through changes at the DNA level, particularly by mutating the DNA encoding the target polypeptide at preselected bases such that codons are generated that will translate into the desired amino acids.

Another means of increasing the number of carbohydrate moieties on the antigen binding protein is by chemical or enzymatic coupling of glycosides to the protein. These procedures are advantageous in that they do not require production of the protein in a host cell that has glycosylation capabilities for N- and O-linked glycosylation. Depending on the coupling mode used, the sugar(s) may be attached to (a) arginine and histidine, (b) free carboxyl groups, (c) free sulfhydryl groups such as those of cysteine, (d) free hydroxyl groups such as those of serine, threonine, or hydroxyproline, (e) aromatic residues such as those of phenylalanine, tyrosine, or tryptophan, or (f) the amide group of glutamine. These methods are described in WO 87/05330 published Sep. 11, 1987, and in Aplin and Wriston, 1981, *CRC Crit. Rev. Biochem.*, pp. 259-306.

Removal of carbohydrate moieties present on the starting antigen binding protein may be accomplished chemically or enzymatically. Chemical deglycosylation requires exposure of the protein to the compound trifluoromethanesulfonic acid, or an equivalent compound. This treatment results in the cleavage of most or all sugars except the linking sugar (N-acetylglucosamine or N-acetylgalactosamine), while leaving the polypeptide intact. Chemical deglycosylation is described by Hakimuddin et al., 1987, *Arch. Biochem. Biophys.* 259:52 and by Edge et al., 1981, *Anal. Biochem.* 118:131. Enzymatic cleavage of carbohydrate moieties on polypeptides can be achieved by the use of a variety of endo- and exo-glycosidases as described by Thotakura et al., 1987, *Meth. Enzymol.* 138:350. Glycosylation at potential glycosylation sites may be prevented by the use of the compound tunicamycin as described by Duskin et al., 1982, *J. Biol. Chem.* 257:3105. Tunicamycin blocks the formation of protein-N-glycoside linkages.

Another type of covalent modification of the antigen binding protein comprises linking the antigen binding protein to various non-proteinaceous polymers, including, but not limited to, various polyols such as polyethylene glycol, polypropylene glycol or polyoxyalkylenes, in the manner set forth in U.S. Pat. Nos. 4,640,835; 4,496,689; 4,301,144; 4,670,417; 4,791,192 or 4,179,337. In addition, as is known in the art, amino acid substitutions may be made in various positions within the antigen binding protein to facilitate the addition of polymers such as PEG.

In some embodiments, the covalent modification of the antigen binding proteins of the invention comprises the addition of one or more labels.

The term "labelling group" means any detectable label. Examples of suitable labelling groups include, but are not limited to, the following: radioisotopes or radionuclides (e.g., $^{3}H$, $^{14}C$, $^{15}N$, $^{35}S$, $^{99}Zr$, $^{90}Y$, $^{99}Tc$, $^{111}In$, $^{125}I$, $^{131}I$), fluorescent groups (e.g., FITC, rhodamine, lanthanide phosphors), enzymatic groups (e.g., horseradish peroxidase, β-galactosidase, luciferase, alkaline phosphatase), chemiluminescent groups, biotinyl groups, or predetermined polypeptide epitopes recognized by a secondary reporter (e.g., leucine zipper pair sequences, binding sites for secondary antibodies, metal binding domains, epitope tags). In some embodiments, the labelling group is coupled to the antigen binding protein via spacer arms of various lengths to reduce potential steric hindrance. Various methods for labelling proteins are known in the art and may be used in performing the present invention.

In general, labels fall into a variety of classes, depending on the assay in which they are to be detected: a) isotopic labels, which may be radioactive or heavy isotopes; b) magnetic labels (e.g., magnetic particles); c) redox active moieties; d) optical dyes; enzymatic groups (e.g. horseradish peroxidase, β-galactosidase, luciferase, alkaline phosphatase); e) biotinylated groups; and f) predetermined polypeptide epitopes recognized by a secondary reporter (e.g., leucine zipper pair sequences, binding sites for secondary antibodies, metal binding domains, epitope tags, etc.). In some embodiments, the labelling group is coupled to the antigen binding protein via spacer arms of various lengths to reduce potential steric hindrance. Various methods for labelling proteins are known in the art and may be used in performing the present invention.

Specific labels include optical dyes, including, but not limited to, chromophores, phosphors and fluorophores, with the latter being specific in many instances. Fluorophores can be either "small molecule" fluores, or proteinaceous fluores.

By "fluorescent label" is meant any molecule that may be detected via its inherent fluorescent properties. Suitable fluorescent labels include, but are not limited to, fluorescein, rhodamine, tetramethylrhodamine, eosin, erythrosin, coumarin, methyl-coumarins, pyrene, Malacite green, stilbene, Lucifer Yellow, Cascade BlueJ, Texas Red, IAEDANS, EDANS, BODIPY FL, LC Red 640, Cy 5, Cy 5.5, LC Red 705, Oregon green, the Alexa-Fluor dyes (Alexa Fluor 350, Alexa Fluor 430, Alexa Fluor 488, Alexa Fluor 546, Alexa Fluor 568, Alexa Fluor 594, Alexa Fluor 633, Alexa Fluor 660, Alexa Fluor 680), Cascade Blue, Cascade Yellow and R-phycoerythrin (PE) (Molecular Probes, Eugene, Oreg.), FITC, Rhodamine, and Texas Red (Pierce, Rockford, Ill.), Cy5, Cy5.5, Cy7 (Amersham Life Science, Pittsburgh, Pa.). Suitable optical dyes, including fluorophores, are described in Molecular Probes Handbook by Richard P. Haugland, hereby expressly incorporated by reference.

Suitable proteinaceous fluorescent labels also include, but are not limited to, green fluorescent protein, including a *Renilla, Ptilosarcus,* or *Aequorea* species of GFP (Chalfie et al., 1994, *Science* 263:802-805), EGFP (Clontech Laboratories, Inc., Genbank Accession Number U55762), blue fluorescent protein (BFP, Quantum Biotechnologies, Inc. 1801 de Maisonneuve Blvd. West, 8th Floor, Montreal, Quebec, Canada H3H 1J9; Stauber, 1998, *Biotechniques* 24:462-471; Heim et al., 1996, *Curr. Biol.* 6:178-182), enhanced yellow fluorescent protein (EYFP, Clontech Laboratories, Inc.), luciferase (Ichiki et al., 1993, *J. Immunol.* 150:5408-5417), β galactosidase (Nolan et al., 1988, *Proc. Natl. Acad. Sci. U.S.A.* 85:2603-2607) and Renilla (WO92/15673, WO95/07463, WO98/14605, WO98/26277, WO99/49019, U.S. Pat. Nos. 5,292,658, 5,418,155, 5,683,888, 5,741,668, 5,777,079, 5,804,387, 5,874,304, 5,876,995, 5,925,558). All of the above-cited references are expressly incorporated herein by reference.

The antibody construct of the invention may also comprise additional domains, which e.g. are helpful in the isolation of the molecule or relate to an adapted pharmacokinetic profile of the molecule.

Domains helpful for the isolation of an antibody construct may be elected from peptide motives or secondarily introduced moieties, which can be captured in an isolation method, e.g. an isolation column. A non-limiting embodiments of such additional domains comprise peptide motives known as Myc-tag, HAT-tag, HA-tag, TAP-tag, GST-tag, chitin binding domain (CBD-tag), maltose binding protein (MBP-tag), Flag-tag, Strep-tag and variants thereof (e.g. Strepll-tag) and His-tag. All herein disclosed antibody constructs characterized by the identified CDRs are preferred to comprise a His-tag domain, which is generally known as a repeat of consecutive His residues in the amino acid sequence of a molecule, preferably of six His residues.

As described in appended example 2 a broad number of CDH19 specific binder has been characterized with respect to identified binding characteristics and those binders were grouped into five different bins, which refers to five different subgroups of CDH19 specific binding domains. Accordingly, in one embodiment the antibody construct of the invention the first binding domain comprises a VH region comprising CDR-H1, CDR-H2 and CDR-H3 and a VL region comprising CDR-L1, CDR-L2 and CDR-L3 selected from the group consisting of:

(a) CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 222, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 252, CDR-H1 as depicted in SEQ ID NO: 82, CDR-H2 as depicted in SEQ ID NO: 83, CDR-H3 as depicted in SEQ ID NO: 84, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 82, CDR-H2 as depicted in SEQ ID NO: 83, CDR-H3 as depicted in SEQ ID NO: 909, CDR-L1 as depicted in SEQ ID NO: 250, CDR-L2 as depicted in SEQ ID NO: 251 and CDR-L3 as depicted in SEQ ID NO: 927, CDR-H1 as depicted in SEQ ID NO: 52, CDR-H2 as depicted in SEQ ID NO: 53, CDR-H3 as depicted in SEQ ID NO: 54, CDR-L1 as depicted in SEQ ID NO: 220, CDR-L2 as depicted in SEQ ID NO: 221 and CDR-L3 as depicted in SEQ ID NO: 926, CDR-H1 as depicted in SEQ ID NO: 52, CDR-H2 as depicted in SEQ ID NO: 53, CDR-H3 as depicted in SEQ ID NO: 904, CDR-L1 as depicted in SEQ ID NO: 220, CDR-L2 as depicted in SEQ ID NO: 221 and CDR-L3 as depicted in SEQ ID NO: 926, CDR-H1 as depicted in SEQ ID NO: 1126, CDR-H2 as depicted in SEQ ID NO: 1127, CDR-H3 as depicted in SEQ ID NO: 1128, CDR-L1 as depicted in SEQ ID NO: 1129, CDR-L2 as depicted in SEQ ID NO: 1130 and CDR-L3 as depicted in SEQ ID NO: 1131, CDR-H1 as depicted in SEQ ID NO: 1165, CDR-H2 as depicted in SEQ ID NO: 1166, CDR-H3 as depicted in SEQ ID NO: 1167, CDR-L1 as depicted in SEQ ID NO: 1168, CDR-L2 as depicted in SEQ ID NO: 1169 and CDR-L3 as depicted in SEQ ID NO: 1170, CDR-H1 as depicted in SEQ ID NO: 1334, CDR-H2 as depicted in SEQ ID NO: 1335, CDR-H3 as depicted in SEQ ID NO: 1336, CDR-L1 as depicted in SEQ ID NO: 1337, CDR-L2 as depicted in SEQ ID NO: 1338 and CDR-L3 as depicted in SEQ ID NO: 1339, CDR-H1 as depicted in SEQ ID NO: 1347, CDR-H2 as depicted in SEQ ID NO: 1348, CDR-H3 as depicted in SEQ ID NO: 1349, CDR-L1 as depicted in SEQ ID NO: 1350, CDR-L2 as depicted in SEQ ID NO: 1351 and CDR-L3 as depicted in SEQ ID NO: 1352, and CDR-H1 as depicted in SEQ ID NO: 1360 CDR-H2 as depicted in SEQ ID NO: 1361, CDR-H3 as depicted in SEQ ID NO: 1362, CDR-L1 as depicted in SEQ ID NO: 1363, CDR-L2 as depicted in SEQ ID NO: 1364 and CDR-L3 as depicted in SEQ ID NO: 1365, CDR-H1 as depicted in SEQ ID NO: 1425 CDR-H2 as depicted in SEQ ID NO: 1426, CDR-H3 as depicted in SEQ ID NO: 1427, CDR-L1 as depicted in SEQ ID NO: 1428, CDR-L2 as depicted in SEQ ID NO: 1429 and CDR-L3 as depicted in SEQ ID NO: 1430, CDR-H1 as depicted in SEQ ID NO: 1438 CDR-H2 as depicted in SEQ ID NO: 1439, CDR-H3 as depicted in SEQ ID NO: 1440, CDR-L1 as depicted in SEQ ID NO: 1441, CDR-L2 as depicted in SEQ ID NO: 1442 and CDR-L3 as depicted in SEQ ID NO: 1443, and CDR-H1 as depicted in SEQ ID NO: 2167 CDR-H2 as depicted in SEQ ID NO: 2168, CDR-H3 as depicted in SEQ ID NO: 2169, CDR-L1 as depicted in SEQ ID NO: 2170, CDR-L2 as depicted in SEQ ID NO: 2171 and CDR-L3 as depicted in SEQ ID NO: 2172, which all characterize binding domains for CDH19 grouped into bin 1;

(b) CDR-H1 as depicted in SEQ ID NO: 124, CDR-H2 as depicted in SEQ ID NO: 125, CDR-H3 as depicted in SEQ ID NO: 126, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 300, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 306, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 312, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 294, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 928, CDR-H1 as depicted in SEQ ID NO: 124, CDR-H2 as depicted in SEQ ID NO: 125, CDR-H3 as depicted in SEQ ID NO: 915, CDR-L1 as depicted in SEQ ID NO: 292, CDR-L2 as depicted in SEQ ID NO: 293 and CDR-L3 as depicted in SEQ ID NO: 929, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 336, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 942, CDR-H1 as depicted in SEQ ID NO: 166, CDR-H2 as depicted in SEQ ID NO: 167, CDR-H3 as depicted in SEQ ID NO: 168, CDR-L1 as depicted in SEQ ID NO: 334, CDR-L2 as depicted in SEQ ID NO: 335 and CDR-L3 as depicted in SEQ ID NO: 943, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 318, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 937, CDR-H1 as depicted in SEQ ID NO: 148, CDR-H2 as depicted in SEQ ID NO: 149, CDR-H3 as depicted in SEQ ID NO: 150, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 148, CDR-H2 as depicted in SEQ ID NO: 149, CDR-H3 as depicted in SEQ ID NO: 919, CDR-L1 as depicted in SEQ ID NO: 316, CDR-L2 as depicted in SEQ ID NO: 317 and CDR-L3 as depicted in SEQ ID NO: 938, CDR-H1 as depicted in SEQ ID NO: 142, CDR-H2 as depicted in SEQ ID NO: 143, CDR-H3 as depicted in SEQ ID NO: 144, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 935, CDR-H1 as depicted in SEQ ID NO: 142, CDR-H2 as depicted in SEQ ID NO: 143, CDR-H3 as depicted in SEQ ID NO: 918, CDR-L1 as depicted in SEQ ID NO: 310, CDR-L2 as depicted in SEQ ID NO: 311 and CDR-L3 as depicted in SEQ ID NO: 936, CDR-H1 as depicted in SEQ ID NO: 136, CDR-H2 as depicted in SEQ ID NO: 137, CDR-H3 as depicted in SEQ ID NO: 138, CDR-L1 as depicted in SEQ ID NO: 304, CDR-L2 as depicted in SEQ ID NO: 305 and CDR-L3 as depicted in SEQ ID NO: 933, CDR-H1 as depicted in SEQ ID NO: 136, CDR-H2 as depicted in SEQ ID NO: 137, CDR-H3 as depicted in SEQ ID NO: 917, CDR-L1 as depicted in SEQ ID NO: 304, CDR-L2 as depicted in SEQ ID NO: 305 and CDR-L3 as depicted in SEQ ID NO: 934, CDR-H1 as depicted in SEQ ID NO: 130, CDR-H2 as depicted in SEQ ID NO: 131, CDR-H3 as depicted in SEQ ID NO: 132, CDR-L1 as depicted in SEQ ID NO: 298, CDR-L2 as depicted in SEQ ID NO: 299 and CDR-L3 as depicted in SEQ ID NO: 930, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 931, CDR-H1 as depicted in SEQ ID NO: 130, CDR-H2 as depicted in SEQ ID NO: 131, CDR-H3 as depicted in SEQ ID NO: 916, CDR-L1 as depicted in SEQ ID NO: 298, CDR-L2 as depicted in SEQ ID NO: 299 and CDR-L3 as depicted in SEQ ID NO: 932, CDR-H1 as depicted in SEQ ID NO: 1009, CDR-H2 as depicted in SEQ ID NO: 1010, CDR-H3 as depicted in SEQ ID NO: 1011, CDR-L1 as depicted in SEQ ID NO: 1012, CDR-L2 as depicted in SEQ ID NO: 1013 and CDR-L3 as depicted in SEQ ID NO: 1014, CDR-H1 as depicted in SEQ ID NO: 1022, CDR-H2 as depicted in SEQ ID NO: 1023, CDR-H3 as depicted in SEQ ID NO: 1024, CDR-L1 as depicted in SEQ ID NO: 1025, CDR-L2 as depicted in SEQ ID NO: 1026 and CDR-L3 as depicted in SEQ ID NO: 1027, CDR-H1 as depicted in SEQ ID NO: 1035, CDR-H2 as depicted in SEQ ID NO: 1036, CDR-H3 as depicted in SEQ ID NO: 1037, CDR-L1 as depicted in SEQ ID NO: 1038, CDR-L2 as depicted in SEQ ID NO: 1039 and CDR-L3 as depicted in SEQ ID NO: 1040, CDR-H1 as depicted in SEQ ID NO: 1074, CDR-H2 as depicted in SEQ ID NO: 1075, CDR-H3 as depicted in SEQ ID NO: 1076, CDR-L1 as depicted in SEQ ID NO: 1077, CDR-L2 as depicted in SEQ ID NO: 1078 and CDR-L3 as depicted in SEQ ID NO: 1079, CDR-H1 as depicted in SEQ ID NO: 1100, CDR-H2 as depicted in SEQ ID NO: 1101, CDR-H3 as depicted in SEQ ID NO: 1102, CDR-L1 as depicted in SEQ ID NO: 1103, CDR-L2 as depicted in SEQ ID NO: 1104 and CDR-L3 as depicted in SEQ ID NO: 1105, CDR-H1 as depicted in SEQ ID NO: 1113, CDR-H2 as depicted in SEQ ID NO: 1114, CDR-H3 as depicted in SEQ ID NO: 1115, CDR-L1 as depicted in SEQ ID NO: 1116, CDR-L2 as depicted in SEQ ID NO: 1117 and CDR-L3 as depicted in SEQ ID NO: 1118, CDR-H1 as depicted in SEQ ID NO: 1243, CDR-H2 as depicted in SEQ ID NO: 1244, CDR-H3 as depicted in SEQ ID NO: 1245, CDR-L1 as depicted in SEQ ID NO: 1246, CDR-L2 as depicted in SEQ ID NO: 1247 and CDR-L3 as depicted in SEQ ID NO: 1248, CDR-H1 as depicted in SEQ ID NO: 1256, CDR-H2 as depicted in SEQ ID NO: 1257, CDR-H3 as depicted in SEQ ID NO: 1258, CDR-L1 as depicted in SEQ ID NO: 1259, CDR-L2 as depicted in SEQ ID NO: 1260 and CDR-L3 as depicted in SEQ ID NO: 1261, CDR-H1 as depicted in SEQ ID NO: 1269, CDR-H2 as depicted in SEQ ID NO: 1270, CDR-H3 as depicted in SEQ ID NO: 1271, CDR-L1 as depicted in SEQ ID NO: 1272, CDR-L2 as depicted in SEQ ID NO: 1273 and CDR-L3 as depicted in SEQ ID NO: 1274, CDR-H1 as depicted in SEQ ID NO: 1282, CDR-H2 as depicted in SEQ ID NO: 1283, CDR-H3 as depicted in SEQ ID NO: 1284, CDR-L1 as depicted in SEQ ID NO: 1285, CDR-L2 as depicted in SEQ ID NO: 1286 and CDR-L3 as depicted in SEQ ID NO: 1287, and CDR-H1 as depicted in SEQ ID NO: 1295, CDR-H2 as depicted in SEQ ID NO: 1296, CDR-H3 as depicted in SEQ ID NO: 1297, CDR-L1 as depicted in SEQ ID NO: 1298, CDR-L2 as depicted in SEQ ID NO: 1299 and CDR-L3 as depicted in SEQ ID NO: 1300, CDR-H1 as depicted in SEQ ID NO: 1647, CDR-H2 as depicted in SEQ ID NO: 1648, CDR-H3 as depicted in SEQ ID NO: 1649, CDR-L1 as depicted in SEQ ID NO: 1650, CDR-L2 as depicted in SEQ ID NO: 1651 and CDR-L3 as depicted in SEQ ID NO: 1652, CDR-H1 as depicted in SEQ ID NO: 1660, CDR-H2 as depicted in SEQ ID NO: 1661, CDR-H3 as depicted in SEQ ID NO: 1662, CDR-L1 as depicted in SEQ ID NO: 1663, CDR-L2 as depicted in SEQ ID NO: 1664 and CDR-L3 as depicted in SEQ ID NO: 1665, CDR-H1 as depicted in SEQ ID NO: 1894, CDR-H2 as depicted in SEQ ID NO: 1895, CDR-H3 as depicted in SEQ ID NO: 1896, CDR-L1 as depicted in SEQ ID NO: 1897, CDR-L2 as depicted in SEQ ID NO: 1898 and CDR-L3 as depicted in SEQ ID NO: 1899, CDR-H1 as depicted in SEQ ID NO: 1907, CDR-H2 as depicted in SEQ ID NO: 1908, CDR-H3 as depicted in SEQ ID NO: 1909, CDR-L1 as depicted in SEQ ID NO: 1910, CDR-L2 as depicted in SEQ ID NO: 1911 and CDR-L3 as depicted in SEQ ID NO: 1912, CDR-H1 as depicted in SEQ ID NO: 1933, CDR-H2 as depicted in SEQ ID NO: 1934, CDR-H3 as depicted in SEQ ID NO: 1935, CDR-L1 as depicted in SEQ ID NO: 1936, CDR-L2 as depicted in SEQ ID NO: 1937 and CDR-L3 as depicted in SEQ ID NO: 1938, CDR-H1 as depicted in SEQ ID NO: 1946, CDR-H2 as depicted in SEQ ID NO: 1947, CDR-H3 as depicted in SEQ ID NO: 1948, CDR-L1 as depicted in SEQ ID NO: 1949, CDR-L2 as depicted in SEQ ID NO: 1950 and CDR-L3 as depicted in SEQ ID NO: 1951, CDR-H1 as depicted in SEQ ID NO: 1959, CDR-H2 as depicted in SEQ ID NO: 1960, CDR-H3 as depicted in SEQ ID NO: 1961, CDR-L1 as depicted in SEQ ID NO: 1962, CDR-L2 as depicted in SEQ ID NO: 1963 and CDR-L3 as depicted in SEQ ID NO: 1964, CDR-H1 as depicted in SEQ ID NO: 1972, CDR-H2 as depicted in SEQ ID NO: 1973, CDR-H3 as depicted in SEQ ID NO: 1974, CDR-L1 as depicted in SEQ ID NO: 1975, CDR-L2 as depicted in SEQ ID NO: 1976 and CDR-L3 as depicted in SEQ ID NO: 1977, CDR-H1 as depicted in SEQ ID NO: 1985, CDR-H2 as depicted in SEQ ID NO: 1986, CDR-H3 as depicted in SEQ ID NO: 1987, CDR-L1 as depicted in SEQ ID NO: 1988, CDR-L2 as depicted in SEQ ID NO: 1989 and CDR-L3 as depicted in SEQ ID NO: 1990, CDR-H1 as depicted in SEQ ID NO: 1998, CDR-H2 as depicted in SEQ ID NO: 1999, CDR-H3 as depicted in SEQ ID NO: 2000, CDR-L1 as depicted in SEQ ID NO: 2001, CDR-L2 as depicted in SEQ ID NO: 2002 and CDR-L3 as depicted in SEQ ID NO: 2003, CDR-H1 as depicted in SEQ ID NO: 2011, CDR-H2 as depicted in SEQ ID NO: 2012, CDR-H3 as depicted in SEQ ID NO: 2013, CDR-L1 as depicted in SEQ ID NO: 2014, CDR-L2 as depicted in SEQ ID NO: 2015 and CDR-L3 as depicted in SEQ ID NO: 2016, CDR-H1 as depicted in SEQ ID NO: 2024, CDR-H2 as depicted in SEQ ID NO: 2025, CDR-H3 as depicted in SEQ ID NO: 2026, CDR-L1 as depicted in SEQ ID NO: 2027, CDR-L2 as depicted in SEQ ID NO: 2028 and CDR-L3 as depicted in SEQ ID NO: 2029, CDR-H1 as depicted in SEQ ID NO: 2037, CDR-H2 as depicted in SEQ ID NO: 2038, CDR-H3 as depicted in SEQ ID NO: 2039, CDR-L1 as depicted in SEQ ID NO: 2040, CDR-L2 as depicted in SEQ ID NO: 2041 and CDR-L3 as depicted in SEQ ID NO: 2042, and CDR-H1 as depicted in SEQ ID NO: 2050, CDR-H2 as depicted in SEQ ID NO: 2051, CDR-H3 as depicted in SEQ ID NO: 2052, CDR-L1 as depicted in SEQ ID NO: 2053, CDR-L2 as depicted in SEQ ID NO: 2054 and CDR-L3 as depicted in SEQ ID NO: 2055, which all characterize binding domains for CDH19 grouped into bin 2;

(c) CDR-H1 as depicted in SEQ ID NO: 94, CDR-H2 as depicted in SEQ ID NO: 95, CDR-H3 as depicted in SEQ ID NO: 96, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 100, CDR-H2 as depicted in SEQ ID NO: 101, CDR-H3 as depicted in SEQ ID NO: 102, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 156, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 100, CDR-H2 as depicted in SEQ ID NO: 101, CDR-H3 as depicted in SEQ ID NO: 912, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 100, CDR-H2 as depicted in SEQ ID NO: 101, CDR-H3 as depicted in SEQ ID NO: 913, CDR-L1 as depicted in SEQ ID NO: 268, CDR-L2 as depicted in SEQ ID NO: 269 and CDR-L3 as depicted in SEQ ID NO: 270, CDR-H1 as depicted in SEQ ID NO: 94, CDR-H2 as depicted in SEQ ID NO: 95, CDR-H3 as depicted in SEQ ID NO: 910, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 94, CDR-H2 as depicted in SEQ ID NO: 95, CDR-H3 as depicted in SEQ ID NO: 911, CDR-L1 as depicted in SEQ ID NO: 262, CDR-L2 as depicted in SEQ ID NO: 263 and CDR-L3 as depicted in SEQ ID NO: 264, CDR-H1 as depicted in SEQ ID NO: 118, CDR-H2 as depicted in SEQ ID NO: 119, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 118, CDR-H2 as depicted in SEQ ID NO: 914, CDR-H3 as depicted in SEQ ID NO: 120, CDR-L1 as depicted in SEQ ID NO: 286, CDR-L2 as depicted in SEQ ID NO: 287 and CDR-L3 as depicted in SEQ ID NO: 288, CDR-H1 as depicted in SEQ ID NO: 154, CDR-H2 as depicted in SEQ ID NO: 155, CDR-H3 as depicted in SEQ ID NO: 920, CDR-L1 as depicted in SEQ ID NO: 322, CDR-L2 as depicted in SEQ ID NO: 323 and CDR-L3 as depicted in SEQ ID NO: 324, CDR-H1 as depicted in SEQ ID NO: 996, CDR-H2 as depicted in SEQ ID NO: 997, CDR-H3 as depicted in SEQ ID NO: 998, CDR-L1 as depicted in SEQ ID NO: 999, CDR-L2 as depicted in SEQ ID NO: 1000 and CDR-L3 as depicted in SEQ ID NO: 1001, CDR-H1 as depicted in SEQ ID NO: 1048, CDR-H2 as depicted in SEQ ID NO: 1049, CDR-H3 as depicted in SEQ ID NO: 1050, CDR-L1 as depicted in SEQ ID NO: 1051, CDR-L2 as depicted in SEQ ID NO: 1052 and CDR-L3 as depicted in SEQ ID NO: 1053, CDR-H1 as depicted in SEQ ID NO: 1087, CDR-H2 as depicted in SEQ ID NO: 1088, CDR-H3 as depicted in SEQ ID NO: 1089, CDR-L1 as depicted in SEQ ID NO: 1090, CDR-L2 as depicted in SEQ ID NO: 1091 and CDR-L3 as depicted in SEQ ID NO: 1092, CDR-H1 as depicted in SEQ ID NO: 1608, CDR-H2 as depicted in SEQ ID NO: 1609, CDR-H3 as depicted in SEQ ID NO: 1610, CDR-L1 as depicted in SEQ ID NO: 1611, CDR-L2 as depicted in SEQ ID NO: 1612 and CDR-L3 as depicted in SEQ ID NO: 1613, CDR-H1 as depicted in SEQ ID NO: 1621, CDR-H2 as depicted in SEQ ID NO: 1622, CDR-H3 as depicted in SEQ ID NO: 1623, CDR-L1 as depicted in SEQ ID NO: 1624, CDR-L2 as depicted in SEQ ID NO: 1625 and CDR-L3 as depicted in SEQ ID NO: 1626, CDR-H1 as depicted in SEQ ID NO: 1634, CDR-H2 as depicted in SEQ ID NO: 1635, CDR-H3 as depicted in SEQ ID NO: 1636, CDR-L1 as depicted in SEQ ID NO: 1637, CDR-L2 as depicted in SEQ ID NO: 1638 and CDR-L3 as depicted in SEQ ID NO: 1639, CDR-H1 as depicted in SEQ ID NO: 1673, CDR-H2 as depicted in SEQ ID NO: 1674, CDR-H3 as depicted in SEQ ID NO: 1675, CDR-L1 as depicted in SEQ ID NO: 1676, CDR-L2 as depicted in SEQ ID NO: 1677 and CDR-L3 as depicted in SEQ ID NO: 1678, CDR-H1 as depicted in SEQ ID NO: 1686, CDR-H2 as depicted in SEQ ID NO: 1687, CDR-H3 as depicted in SEQ ID NO: 1688, CDR-L1 as depicted in SEQ ID NO: 1689, CDR-L2 as depicted in SEQ ID NO: 1690 and CDR-L3 as depicted in SEQ ID NO: 1691, CDR-H1 as depicted in SEQ ID NO: 1699, CDR-H2 as depicted in SEQ ID NO: 1700, CDR-H3 as depicted in SEQ ID NO: 1701, CDR-L1 as depicted in SEQ ID NO: 1702, CDR-L2 as depicted in SEQ ID NO: 1703 and CDR-L3 as depicted in SEQ ID NO: 1704, CDR-H1 as depicted in SEQ ID NO: 1712, CDR-H2 as depicted in SEQ ID NO: 1713, CDR-H3 as depicted in SEQ ID NO: 1714, CDR-L1 as depicted in SEQ ID NO: 1715, CDR-L2 as depicted in SEQ ID NO: 1716 and CDR-L3 as depicted in SEQ ID NO: 1717, CDR-H1 as depicted in SEQ ID NO: 1725, CDR-H2 as depicted in SEQ ID NO: 1726, CDR-H3 as depicted in SEQ ID NO: 1727, CDR-L1 as depicted in SEQ ID NO: 1728, CDR-L2 as depicted in SEQ ID NO: 1729 and CDR-L3 as depicted in SEQ ID NO: 1730, CDR-H1 as depicted in SEQ ID NO: 1738, CDR-H2 as depicted in SEQ ID NO: 1739, CDR-H3 as depicted in SEQ ID NO: 1740, CDR-L1 as depicted in SEQ ID NO: 1741, CDR-L2 as depicted in SEQ ID NO: 1742 and CDR-L3 as depicted in SEQ ID NO 1743, CDR-H1 as depicted in SEQ ID NO: 1751, CDR-H2 as depicted in SEQ ID NO: 1752, CDR-H3 as depicted in SEQ ID NO: 1753, CDR-L1 as depicted in SEQ ID NO: 1754, CDR-L2 as depicted in SEQ ID NO: 1755 and CDR-L3 as depicted in SEQ ID NO: 1756, CDR-H1 as depicted in SEQ ID NO: 1764, CDR-H2 as depicted in SEQ ID NO: 1765, CDR-H3 as depicted in SEQ ID NO: 1766, CDR-L1 as depicted in SEQ ID NO: 1767, CDR-L2 as depicted in SEQ ID NO: 1768 and CDR-L3 as depicted in SEQ ID NO: 1769, and CDR-H1 as depicted in SEQ ID NO: 1920, CDR-H2 as depicted in SEQ ID NO: 1921, CDR-H3 as depicted in SEQ ID NO: 1922, CDR-L1 as depicted in SEQ ID NO: 1923, CDR-L2 as depicted in SEQ ID NO: 1924 and CDR-L3 as depicted in SEQ ID NO: 1925, which all characterize binding domains for CDH19 grouped into bin 3;

(d) CDR-H1 as depicted in SEQ ID NO: 4, CDR-H2 as depicted in SEQ ID NO: 5, CDR-H3 as depicted in SEQ ID NO: 6, CDR-L1 as depicted in SEQ ID NO: 172, CDR-L2 as depicted in SEQ ID NO: 173 and CDR-L3 as depicted in SEQ ID NO: 174, CDR-H1 as depicted in SEQ ID NO: 10, CDR-H2 as depicted in SEQ ID NO: 11, CDR-H3 as depicted in SEQ ID NO: 12, CDR-L1 as depicted in SEQ ID NO: 178, CDR-L2 as depicted in SEQ ID NO: 179 and CDR-L3 as depicted in SEQ ID NO: 180, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 198, CDR-H1 as depicted in SEQ ID NO: 34, CDR-H2 as depicted in SEQ ID NO: 35, CDR-H3 as depicted in SEQ ID NO: 36, CDR-L1 as depicted in SEQ ID NO: 202, CDR-L2 as depicted in SEQ ID NO: 203 and CDR-L3 as depicted in SEQ ID NO: 204, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 214, CDR-L2 as depicted in SEQ ID NO: 215 and CDR-L3 as depicted in SEQ ID NO: 216, CDR-H1 as depicted in SEQ ID NO: 58, CDR-H2 as depicted in SEQ ID NO: 59, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 64, CDR-H2 as depicted in SEQ ID NO: 65, CDR-H3 as depicted in SEQ ID NO: 66, CDR-L1 as depicted in SEQ ID NO: 232, CDR-L2 as depicted in SEQ ID NO: 233 and CDR-L3 as depicted in SEQ ID NO: 234, CDR-H1 as depicted in SEQ ID NO: 70, CDR-H2 as depicted in SEQ ID NO: 71, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 328, CDR-L2 as depicted in SEQ ID NO: 329 and CDR-L3 as depicted in SEQ ID NO: 330, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 902, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 903, CDR-L1 as depicted in SEQ ID NO: 924, CDR-L2 as depicted in SEQ ID NO: 215 and CDR-L3 as depicted in SEQ ID NO: 216, CDR-H1 as depicted in SEQ ID NO: 46, CDR-H2 as depicted in SEQ ID NO: 47, CDR-H3 as depicted in SEQ ID NO: 48, CDR-L1 as depicted in SEQ ID NO: 925, CDR-L2 as depicted in SEQ ID NO: 215 and CDR-L3 as depicted in SEQ ID NO: 216, CDR-H1 as depicted in SEQ ID NO: 70, CDR-H2 as depicted in SEQ ID NO: 907, CDR-H3 as depicted in SEQ ID NO: 72, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 70, CDR-H2 as depicted in SEQ ID NO: 907, CDR-H3 as depicted in SEQ ID NO: 908, CDR-L1 as depicted in SEQ ID NO: 238, CDR-L2 as depicted in SEQ ID NO: 239 and CDR-L3 as depicted in SEQ ID NO: 240, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 58, CDR-H2 as depicted in SEQ ID NO: 905, CDR-H3 as depicted in SEQ ID NO: 906, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 58, CDR-H2 as depicted in SEQ ID NO: 905, CDR-H3 as depicted in SEQ ID NO: 60, CDR-L1 as depicted in SEQ ID NO: 226, CDR-L2 as depicted in SEQ ID NO: 227 and CDR-L3 as depicted in SEQ ID NO: 228, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 160, CDR-H2 as depicted in SEQ ID NO: 921, CDR-H3 as depicted in SEQ ID NO: 162, CDR-L1 as depicted in SEQ ID NO: 939, CDR-L2 as depicted in SEQ ID NO: 329 and CDR-L3 as depicted in SEQ ID NO: 940, CDR-H1 as depicted in SEQ ID NO: 160, CDR-H2 as depicted in SEQ ID NO: 161, CDR-H3 as depicted in SEQ ID NO: 162, CDR-L1 as depicted in SEQ ID NO: 941, CDR-L2 as depicted in SEQ ID NO: 329 and CDR-L3 as depicted in SEQ ID NO: 330, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 196, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 901, CDR-H3 as depicted in SEQ ID NO: 30, CDR-L1 as depicted in SEQ ID NO: 922, CDR-L2 as depicted in SEQ ID NO: 197 and CDR-L3 as depicted in SEQ ID NO: 923, CDR-H1 as depicted in SEQ ID NO: 28, CDR-H2 as depicted in SEQ ID NO: 29, CDR-H3 as depicted in SEQ ID NO: 30, CDR-L1 as depicted in SEQ ID NO: 939, CDR-L2 as depicted in SEQ ID NO: 329 and CDR-L3 as depicted in SEQ ID NO: 330, CDR-H1 as depicted in SEQ ID NO: 970, CDR-H2 as depicted in SEQ ID NO: 971, CDR-H3 as depicted in SEQ ID NO: 972, CDR-L1 as depicted in SEQ ID NO: 973, CDR-L2 as depicted in SEQ ID NO: 974 and CDR-L3 as depicted in SEQ ID NO: 975, CDR-H1 as depicted in SEQ ID NO: 1061, CDR-H2 as depicted in SEQ ID NO: 1062, CDR-H3 as depicted in SEQ ID NO: 1063, CDR-L1 as depicted in SEQ ID NO: 1064, CDR-L2 as depicted in SEQ ID NO: 1065 and CDR-L3 as depicted in SEQ ID NO: 1066, CDR-H1 as depicted in SEQ ID NO: 1139, CDR-H2 as depicted in SEQ ID NO: 1140, CDR-H3 as depicted in SEQ ID NO: 1141, CDR-L1 as depicted in SEQ ID NO: 1142, CDR-L2 as depicted in SEQ ID NO: 1143 and CDR-L3 as depicted in SEQ ID NO: 1144, CDR-H1 as depicted in SEQ ID NO: 1152, CDR-H2 as depicted in SEQ ID NO: 1153, CDR-H3 as depicted in SEQ ID NO: 1154, CDR-L1 as depicted in SEQ ID NO: 1155, CDR-L2 as depicted in SEQ ID NO: 1156 and CDR-L3 as depicted in SEQ ID NO: 1157, CDR-H1 as depicted in SEQ ID NO: 1178, CDR-H2 as depicted in SEQ ID NO: 1179, CDR-H3 as depicted in SEQ ID NO: 1180, CDR-L1 as depicted in SEQ ID NO: 1181, CDR-L2 as depicted in SEQ ID NO: 1182 and CDR-L3 as depicted in SEQ ID NO: 1183, CDR-H1 as depicted in SEQ ID NO: 1191, CDR-H2 as depicted in SEQ ID NO: 1192, CDR-H3 as depicted in SEQ ID NO: 1193, CDR-L1 as depicted in SEQ ID NO: 1194, CDR-L2 as depicted in SEQ ID NO: 1195 and CDR-L3 as depicted in SEQ ID NO: 1196, CDR-H1 as depicted in SEQ ID NO: 1204, CDR-H2 as depicted in SEQ ID NO: 1205, CDR-H3 as depicted in SEQ ID NO: 1206, CDR-L1 as depicted in SEQ ID NO: 1207, CDR-L2 as depicted in SEQ ID NO: 1208 and CDR-L3 as depicted in SEQ ID NO: 1209, CDR-H1 as depicted in SEQ ID NO: 1217, CDR-H2 as depicted in SEQ ID NO: 1218, CDR-H3 as depicted in SEQ ID NO: 1219, CDR-L1 as depicted in SEQ ID NO: 1220, CDR-L2 as depicted in SEQ ID NO: 1221 and CDR-L3 as depicted in SEQ ID NO: 1222, CDR-H1 as depicted in SEQ ID NO: 1230, CDR-H2 as depicted in SEQ ID NO: 1231, CDR-H3 as depicted in SEQ ID NO: 1232, CDR-L1 as depicted in SEQ ID NO: 1233, CDR-L2 as depicted in SEQ ID NO: 1234 and CDR-L3 as depicted in SEQ ID NO: 1235, CDR-H1 as depicted in SEQ ID NO: 1308, CDR-H2 as depicted in SEQ ID NO: 1309, CDR-H3 as depicted in SEQ ID NO: 1310, CDR-L1 as depicted in SEQ ID NO: 1311, CDR-L2 as depicted in SEQ ID NO: 1312 and CDR-L3 as depicted in SEQ ID NO: 1313, CDR-H1 as depicted in SEQ ID NO: 1321, CDR-H2 as depicted in SEQ ID NO: 1322, CDR-H3 as depicted in SEQ ID NO: 1323, CDR-L1 as depicted in SEQ ID NO: 1324, CDR-L2 as depicted in SEQ ID NO: 1325 and CDR-L3 as depicted in SEQ ID NO: 1326, CDR-H1 as depicted in SEQ ID NO: 1373, CDR-H2 as depicted in SEQ ID NO: 1374, CDR-H3 as depicted in SEQ ID NO: 1375, CDR-L1 as depicted in SEQ ID NO: 1376, CDR-L2 as depicted in SEQ ID NO: 1377 and CDR-L3 as depicted in SEQ ID NO: 1378, CDR-H1 as depicted in SEQ ID NO: 1386, CDR-H2 as depicted in SEQ ID NO: 1387, CDR-H3 as depicted in SEQ ID NO: 1388, CDR-L1 as depicted in SEQ ID NO: 1389, CDR-L2 as depicted in SEQ ID NO: 1390 and CDR-L3 as depicted in SEQ ID NO: 1391, CDR-H1 as depicted in SEQ ID NO: 1399, CDR-H2 as depicted in SEQ ID NO: 1400, CDR-H3 as depicted in SEQ ID NO: 1401, CDR-L1 as depicted in SEQ ID NO: 1402, CDR-L2 as depicted in SEQ ID NO: 1403 and CDR-L3 as depicted in SEQ ID NO: 1404, CDR-H1 as depicted in SEQ ID NO: 1412, CDR-H2 as depicted in SEQ ID NO: 1413, CDR-H3 as depicted in SEQ ID NO: 1414, CDR-L1 as depicted in SEQ ID NO: 1415, CDR-L2 as depicted in SEQ ID NO: 1416 and CDR-L3 as depicted in SEQ ID NO: 1417, CDR-H1 as depicted in SEQ ID NO: 1777, CDR-H2 as depicted in SEQ ID NO: 1778, CDR-H3 as depicted in SEQ ID NO: 1779, CDR-L1 as depicted in SEQ ID NO: 1780, CDR-L2 as depicted in SEQ ID NO: 1781 and CDR-L3 as depicted in SEQ ID NO: 1782, CDR-H1 as depicted in SEQ ID NO: 1790, CDR-H2 as depicted in SEQ ID NO: 1791, CDR-H3 as depicted in SEQ ID NO: 1792, CDR-L1 as depicted in SEQ ID NO: 1793, CDR-L2 as depicted in SEQ ID NO: 1794 and CDR-L3 as depicted in SEQ ID NO: 1795, CDR-H1 as depicted in SEQ ID NO: 1803, CDR-H2 as depicted in SEQ ID NO: 1804, CDR-H3 as depicted in SEQ ID NO: 1805, CDR-L1 as depicted in SEQ ID NO: 1806, CDR-L2 as depicted in SEQ ID NO: 1807 and CDR-L3 as depicted in SEQ ID NO: 1808, CDR-H1 as depicted in SEQ ID NO: 1816, CDR-H2 as depicted in SEQ ID NO: 1817, CDR-H3 as depicted in SEQ ID NO: 1818, CDR-L1 as depicted in SEQ ID NO: 1819, CDR-L2 as depicted in SEQ ID NO: 1820 and CDR-L3 as depicted in SEQ ID NO: 1821, CDR-H1 as depicted in SEQ ID NO: 1829, CDR-H2 as depicted in SEQ ID NO: 1830, CDR-H3 as depicted in SEQ ID NO: 1831, CDR-L1 as depicted in SEQ ID NO: 1832, CDR-L2 as depicted in SEQ ID NO: 1833 and CDR-L3 as depicted in SEQ ID NO: 1834, CDR-H1 as depicted in SEQ ID NO: 1842, CDR-H2 as depicted in SEQ ID NO: 1843, CDR-H3 as depicted in SEQ ID NO: 1844, CDR-L1 as depicted in SEQ ID NO: 1845, CDR-L2 as depicted in SEQ ID NO: 1846 and CDR-L3 as depicted in SEQ ID NO: 1847, CDR-H1 as depicted in SEQ ID NO: 1855, CDR-H2 as depicted in SEQ ID NO: 1856, CDR-H3 as depicted in SEQ ID NO: 1857, CDR-L1 as depicted in SEQ ID NO: 1858, CDR-L2 as depicted in SEQ ID NO: 1859 and CDR-L3 as depicted in SEQ ID NO: 1860, CDR-H1 as depicted in SEQ ID NO: 1868, CDR-H2 as depicted in SEQ ID NO: 1869, CDR-H3 as depicted in SEQ ID NO: 1870, CDR-L1 as depicted in SEQ ID NO: 1871, CDR-L2 as depicted in SEQ ID NO: 1872 and CDR-L3 as depicted in SEQ ID NO: 1873, CDR-H1 as depicted in SEQ ID NO: 1881, CDR-H2 as depicted in SEQ ID NO: 1882, CDR-H3 as depicted in SEQ ID NO: 1883, CDR-L1 as depicted in SEQ ID NO: 1884, CDR-L2 as depicted in SEQ ID NO: 1885 and CDR-L3 as depicted in SEQ ID NO 1886, CDR-H1 as depicted in SEQ ID NO: 2063, CDR-H2 as depicted in SEQ ID NO: 2064, CDR-H3 as depicted in SEQ ID NO: 2065, CDR-L1 as depicted in SEQ ID NO: 2066, CDR-L2 as depicted in SEQ ID NO: 2067 and CDR-L3 as depicted in SEQ ID NO: 2068, CDR-H1 as depicted in SEQ ID NO: 2076, CDR-H2 as depicted in SEQ ID NO: 2077, CDR-H3 as depicted in SEQ ID NO: 2078, CDR-L1 as depicted in SEQ ID NO: 2079, CDR-L2 as depicted in SEQ ID NO: 2080 and CDR-L3 as depicted in SEQ ID NO: 2081, CDR-H1 as depicted in SEQ ID NO: 2089, CDR-H2 as depicted in SEQ ID NO: 2090, CDR-H3 as depicted in SEQ ID NO: 2091, CDR-L1 as depicted in SEQ ID NO: 2092, CDR-L2 as depicted in SEQ ID NO: 2093 and CDR-L3 as depicted in SEQ ID NO: 2094, CDR-H1 as depicted in SEQ ID NO: 2102, CDR-H2 as depicted in SEQ ID NO: 2103, CDR-H3 as depicted in SEQ ID NO: 2104, CDR-L1 as depicted in SEQ ID NO: 2105, CDR-L2 as depicted in SEQ ID NO: 2106 and CDR-L3 as depicted in SEQ ID NO: 2107, CDR-H1 as depicted in SEQ ID NO: 2115, CDR-H2 as depicted in SEQ ID NO: 2116, CDR-H3 as depicted in SEQ ID NO: 2117, CDR-L1 as depicted in SEQ ID NO: 2118, CDR-L2 as depicted in SEQ ID NO: 2119 and CDR-L3 as depicted in SEQ ID NO: 2120, CDR-H1 as depicted in SEQ ID NO: 2128, CDR-H2 as depicted in SEQ ID NO: 2129, CDR-H3 as depicted in SEQ ID NO: 2130, CDR-L1 as depicted in SEQ ID NO: 2131, CDR-L2 as depicted in SEQ ID NO: 2132 and CDR-L3 as depicted in SEQ ID NO: 2133, CDR-H1 as depicted in SEQ ID NO: 2141, CDR-H2 as depicted in SEQ ID NO: 2142, CDR-H3 as depicted in SEQ ID NO: 2143, CDR-L1 as depicted in SEQ ID NO: 2144, CDR-L2 as depicted in SEQ ID NO: 2145 and CDR-L3 as depicted in SEQ ID NO: 2146, CDR-H1 as depicted in SEQ ID NO: 2154, CDR-H2 as depicted in SEQ ID NO: 2155, CDR-H3 as depicted in SEQ ID NO: 2156, CDR-L1 as depicted in SEQ ID NO: 2157, CDR-L2 as depicted in SEQ ID NO: 2158 and CDR-L3 as depicted in SEQ ID NO: 2159, CDR-H1 as depicted in SEQ ID NO: 2180, CDR-H2 as depicted in SEQ ID NO: 2181, CDR-H3 as depicted in SEQ ID NO: 2182, CDR-L1 as depicted in SEQ ID NO: 2183, CDR-L2 as depicted in SEQ ID NO: 2184 and CDR-L3 as depicted in SEQ ID NO: 2185, CDR-H1 as depicted in SEQ ID NO: 2193, CDR-H2 as depicted in SEQ ID NO: 2194, CDR-H3 as depicted in SEQ ID NO: 2195, CDR-L1 as depicted in SEQ ID NO: 2196, CDR-L2 as depicted in SEQ ID NO: 2197 and CDR-L3 as depicted in SEQ ID NO: 2198, and CDR-H1 as depicted in SEQ ID NO: 2206, CDR-H2 as depicted in SEQ ID NO: 2207, CDR-H3 as depicted in SEQ ID NO: 2208, CDR-L1 as depicted in SEQ ID NO: 2209, CDR-L2 as depicted in SEQ ID NO: 2210 and CDR-L3 as depicted in SEQ ID NO: 2211 which all characterize binding domains for CDH19 grouped into bin 4; and (e) CDR-H1 as depicted in SEQ ID NO: 76, CDR-H2 as depicted in SEQ ID NO: 77, CDR-H3 as depicted in SEQ ID NO: 78, CDR-L1 as depicted in SEQ ID NO: 244, CDR-L2 as depicted in SEQ ID NO: 245 and CDR-L3 as depicted in SEQ ID NO: 246, CDR-H1 as depicted in SEQ ID NO: 88, CDR-H2 as depicted in SEQ ID NO: 89, CDR-H3 as depicted in SEQ ID NO: 90, CDR-L1 as depicted in SEQ ID NO: 256, CDR-L2 as depicted in SEQ ID NO: 257 and CDR-L3 as depicted in SEQ ID NO: 258, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 112, CDR-H2 as depicted in SEQ ID NO: 113, CDR-H3 as depicted in SEQ ID NO: 114, CDR-L1 as depicted in SEQ ID NO: 280, CDR-L2 as depicted in SEQ ID NO: 281 and CDR-L3 as depicted in SEQ ID NO: 282, CDR-H1 as depicted in SEQ ID NO: 106, CDR-H2 as depicted in SEQ ID NO: 107, CDR-H3 as depicted in SEQ ID NO: 108, CDR-L1 as depicted in SEQ ID NO: 274, CDR-L2 as depicted in SEQ ID NO: 275 and CDR-L3 as depicted in SEQ ID NO: 276, CDR-H1 as depicted in SEQ ID NO: 983, CDR-H2 as depicted in SEQ ID NO: 984, CDR-H3 as depicted in SEQ ID NO: 985, CDR-L1 as depicted in SEQ ID NO: 986, CDR-L2 as depicted in SEQ ID NO: 987 and CDR-L3 as depicted in SEQ ID NO: 988, CDR-H1 as depicted in SEQ ID NO: 1582, CDR-H2 as depicted in SEQ ID NO: 1583, CDR-H3 as depicted in SEQ ID NO: 1584, CDR-L1 as depicted in SEQ ID NO: 1585, CDR-L2 as depicted in SEQ ID NO: 1586 and CDR-L3 as depicted in SEQ ID NO: 1587, and CDR-H1 as depicted in SEQ ID NO: 1595, CDR-H2 as depicted in SEQ ID NO: 1596, CDR-H3 as depicted in SEQ ID NO: 1597, CDR-L1 as depicted in SEQ ID NO: 1598, CDR-L2 as depicted in SEQ ID NO: 1599 and CDR-L3 as depicted in SEQ ID NO: 1600, which all characterize binding domains for CDH19 grouped into bin 5.

In a further embodiment of the antibody construct of the invention the first binding domain comprises a VH region selected from the group consisting of VH regions (a) as depicted in SEQ ID NO: 362, SEQ ID NO: 364, SEQ ID NO: 485, SEQ ID NO: 486, SEQ ID NO: 487, SEQ ID NO: 492, SEQ ID NO: 493, SEQ ID NO: 494, SEQ ID NO: 495, SEQ ID NO: 1133, SEQ ID NO: 1172, SEQ ID NO: 1341, SEQ ID NO: 1354, SEQ ID NO: 1367, SEQ ID NO: 1432, SEQ ID NO: 1445 and SEQ ID NO: 2174, grouped into bin 1;

(b) as depicted in SEQ ID NO: 342, SEQ ID NO: 366, SEQ ID NO: 370, SEQ ID NO: 344, SEQ ID NO: 372, SEQ ID NO: 368, SEQ ID NO: 496, SEQ ID NO: 497, SEQ ID NO: 498, SEQ ID NO: 499, SEQ ID NO: 500, SEQ ID NO: 508, SEQ ID NO: 509, SEQ ID NO: 510, SEQ ID NO: 511, SEQ ID NO: 512, SEQ ID NO: 519, SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 1016, SEQ ID NO: 1029, SEQ ID NO: 1042, SEQ ID NO: 1081, SEQ ID NO: 1107, SEQ ID NO: 1120, SEQ ID NO: 1250, SEQ ID NO: 1263, SEQ ID NO: 1276, SEQ ID NO: 1289, SEQ ID NO: 1302, SEQ ID NO: 1654, SEQ ID NO: 1667, SEQ ID NO: 1901, SEQ ID NO: 1914, SEQ ID NO: 1940, SEQ ID NO: 1953, SEQ ID NO: 1966, SEQ ID NO: 1979, SEQ ID NO: 1992, SEQ ID NO: 2005, SEQ ID NO: 2018, SEQ ID NO: 2031, SEQ ID NO: 2044, and SEQ ID NO: 2057, grouped into bin 2;

(c) as depicted in SEQ ID NO: 338, SEQ ID NO: 354, SEQ ID NO: 378, SEQ ID NO: 356, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 501, SEQ ID NO: 502, SEQ ID NO: 503, SEQ ID NO: 504, SEQ ID NO: 505, SEQ ID NO: 506, SEQ ID NO: 517, SEQ ID NO: 518, SEQ ID NO: 1003, SEQ ID NO: 1055, SEQ ID NO: 1094, SEQ ID NO: 1615, SEQ ID NO: 1628, SEQ ID NO: 1641, SEQ ID NO: 1680, SEQ ID NO: 1693, SEQ ID NO: 1706, SEQ ID NO: 1719, SEQ ID NO: 1732, SEQ ID NO: 1745, SEQ ID NO: 1758, SEQ ID NO: 1771, and SEQ ID NO: 1927, grouped into bin 3;

(d) as depicted in SEQ ID NO: 352, SEQ ID NO: 360, SEQ ID NO: 388, SEQ ID NO: 386, SEQ ID NO: 340, SEQ ID NO: 346, SEQ ID NO: 374, SEQ ID NO: 348, SEQ ID NO: 390, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 488, SEQ ID NO: 489, SEQ ID NO: 490, SEQ ID NO: 491, SEQ ID NO: 513, SEQ ID NO: 514, SEQ ID NO: 515, SEQ ID NO: 516, SEQ ID NO: 540, SEQ ID NO: 541, SEQ ID NO: 542, SEQ ID NO: 543, SEQ ID NO: 977, SEQ ID NO: 1068, SEQ ID NO: 1146, SEQ ID NO: 1159, SEQ ID NO: 1185, SEQ ID NO: 1198, SEQ ID NO: 1211, SEQ ID NO: 1224, SEQ ID NO: 1237, SEQ ID NO: 1315, SEQ ID NO: 1328, SEQ ID NO: 1380, SEQ ID NO: 1393, SEQ ID NO: 1406, SEQ ID NO: 1419, SEQ ID NO: 1469, SEQ ID NO: 1478, SEQ ID NO: 1485, SEQ ID NO: 1494, SEQ ID NO: 1501, SEQ ID NO: 1508, SEQ ID NO: 1519, SEQ ID NO: 1526, SEQ ID NO: 1533, SEQ ID NO: 1542, SEQ ID NO: 1549, SEQ ID NO: 1558, SEQ ID NO: 1565, SEQ ID NO: 1784, SEQ ID NO: 1797, SEQ ID NO: 1810, SEQ ID NO: 1823, SEQ ID NO: 1836, SEQ ID NO: 1849, SEQ ID NO: 1862, SEQ ID NO: 1875, SEQ ID NO: 1888, SEQ ID NO: 2070, SEQ ID NO: 2083, SEQ ID NO: 2096, SEQ ID NO: 2109, SEQ ID NO: 2122, SEQ ID NO: 2135, SEQ ID NO: 2148, SEQ ID NO: 2161, SEQ ID NO: 2187, SEQ ID NO: 2200, and SEQ ID NO: 2213, grouped into bin 4; and (e) as depicted in SEQ ID NO: 376, SEQ ID NO: 392, SEQ ID NO: 358, SEQ ID NO: 350, SEQ ID NO: 507, SEQ ID NO: 990, SEQ ID NO: 1589, and SEQ ID NO: 1602, grouped into bin 5.

In another embodiment of the antibody construct of the invention the first binding domain comprises a VL region selected from the group consisting of VL regions (a) as depicted in SEQ ID NO: 418, SEQ ID NO: 420, SEQ ID NO: 580, SEQ ID NO: 581, SEQ ID NO: 582, SEQ ID NO: 587, SEQ ID NO: 588, SEQ ID NO: 589, SEQ ID NO: 590, SEQ ID NO: 1135, SEQ ID NO: 1174, SEQ ID NO: 1343, SEQ ID NO: 1356, SEQ ID NO: 1369, SEQ ID NO: 1434, SEQ ID NO: 1447 and SEQ ID NO: 2176, grouped into bin 1;

(b) as depicted in SEQ ID NO: 398, SEQ ID NO: 422, SEQ ID NO: 426, SEQ ID NO: 400, SEQ ID NO: 428, SEQ ID NO: 424, SEQ ID NO: 591, SEQ ID NO: 592, SEQ ID NO: 593, SEQ ID NO: 594, SEQ ID NO: 595, SEQ ID NO: 603, SEQ ID NO: 604, SEQ ID NO: 605, SEQ ID NO: 606, SEQ ID NO: 607, SEQ ID NO: 614, SEQ ID NO: 615, SEQ ID NO: 616, SEQ ID NO: 617, SEQ ID NO: 618, SEQ ID NO: 619, SEQ ID NO: 620, SEQ ID NO: 621, SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 1018, SEQ ID NO: 1031, SEQ ID NO: 1044, SEQ ID NO: 1083, SEQ ID NO: 1109, SEQ ID NO: 1122, SEQ ID NO: 1252, SEQ ID NO: 1265, SEQ ID NO: 1278, SEQ ID NO: 1291, SEQ ID NO: 1304, SEQ ID NO: 1656, SEQ ID NO: 1669, SEQ ID NO: 1903, SEQ ID NO: 1916, SEQ ID NO: 1942, SEQ ID NO: 1955, SEQ ID NO: 1968, SEQ ID NO: 1981, SEQ ID NO: 1994, SEQ ID NO: 2007, SEQ ID NO: 2020, SEQ ID NO: 2033, SEQ ID NO: 2046, and SEQ ID NO: 2059, grouped into bin 2;

(c) as depicted in SEQ ID NO: 394, SEQ ID NO: 410, SEQ ID NO: 434, SEQ ID NO: 412, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 596, SEQ ID NO: 597, SEQ ID NO: 598, SEQ ID NO: 599, SEQ ID NO: 600, SEQ ID NO: 601, SEQ ID NO: 612, SEQ ID NO: 613, SEQ ID NO: 1005, SEQ ID NO: 1057, SEQ ID NO: 1096, SEQ ID NO: 1617, SEQ ID NO: 1630, SEQ ID NO: 1643, SEQ ID NO: 1682, SEQ ID NO: 1695, SEQ ID NO: 1708, SEQ ID NO: 1721, SEQ ID NO: 1734, SEQ ID NO: 1747, SEQ ID NO: 1760, SEQ ID NO: 1773, and SEQ ID NO: 1929, grouped into bin 3;

(d) as depicted in SEQ ID NO: 408, SEQ ID NO: 416, SEQ ID NO: 444, SEQ ID NO: 442, SEQ ID NO: 396, SEQ ID NO: 402, SEQ ID NO: 430, SEQ ID NO: 404, SEQ ID NO: 446, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 583, SEQ ID NO: 584, SEQ ID NO: 585, SEQ ID NO: 586, SEQ ID NO: 608, SEQ ID NO: 609, SEQ ID NO: 610, SEQ ID NO: 611, SEQ ID NO: 635, SEQ ID NO: 636, SEQ ID NO: 637, SEQ ID NO: 638, SEQ ID NO: 979, SEQ ID NO: 1070, SEQ ID NO: 1148, SEQ ID NO: 1161, SEQ ID NO: 1187, SEQ ID NO: 1200, SEQ ID NO: 1213, SEQ ID NO: 1226, SEQ ID NO: 1239, SEQ ID NO: 1317, SEQ ID NO: 1330, SEQ ID NO: 1382, SEQ ID NO: 1395, SEQ ID NO: 1408, SEQ ID NO: 1421, SEQ ID NO: 1471, SEQ ID NO: 1480, SEQ ID NO: 1487, SEQ ID NO: 1496, SEQ ID NO: 1503, SEQ ID NO: 1510, SEQ ID NO: 1521, SEQ ID NO: 1528, SEQ ID NO: 1535, SEQ ID NO: 1544, SEQ ID NO: 1551, SEQ ID NO: 1560, SEQ ID NO: 1567, SEQ ID NO: 1786, SEQ ID NO: 1799, SEQ ID NO: 1812, SEQ ID NO: 1825, SEQ ID NO: 1838, SEQ ID NO: 1851, SEQ ID NO: 1864, SEQ ID NO: 1877, SEQ ID NO: 1890, SEQ ID NO: 2072, SEQ ID NO: 2085, SEQ ID NO: 2098, SEQ ID NO: 2111, SEQ ID NO: 2124, SEQ ID NO: 2137, SEQ ID NO: 2150, SEQ ID NO: 2163, SEQ ID NO: 2189, SEQ ID NO: 2202, and SEQ ID NO: 2215, grouped into bin 4; and (e) as depicted in SEQ ID NO: 432, SEQ ID NO: 448, SEQ ID NO: 414, SEQ ID NO: 406, SEQ ID NO: 602, SEQ ID NO: 992, SEQ ID NO: 1591, and SEQ ID NO: 1604, grouped into bin 5.

The invention further provides an embodiment of the antibody construct of the invention, wherein the first binding domain comprises a VH region and a VL region selected from the group consisting of:

(1) pairs of a VH region and a VL region as depicted in SEQ ID NOs: 362+418, SEQ ID NOs: 364+420, SEQ ID NOs: 485+580, SEQ ID NOs: 486+581, SEQ ID NOs: 487+582, SEQ ID NOs: 492+587, SEQ ID NOs: 493+588, SEQ ID NOs: 494+589, SEQ ID NOs: 495+590, SEQ ID NOs: 1133+1135, SEQ ID NOs: 1172+1174, SEQ ID NOs: 1341+1343, SEQ ID NOs: 1354+1356, SEQ ID NOs: 1367+1369, SEQ ID NOs: 1432+1434, SEQ ID NOs: 1445+1447, and SEQ ID NOs: 2174+2176, all pairs grouped into bin 1;

(2) pairs of a VH region and a VL region as depicted in SEQ ID NOs: 342+398, SEQ ID NOs: 366+422, SEQ ID NOs: 370+426, SEQ ID NOs: 344+400, SEQ ID NOs: 372+428, SEQ ID NOs: 368+424, SEQ ID NOs: 496+591, SEQ ID NOs: 497+592, SEQ ID NOs: 498+593, SEQ ID NOs: 499+594, SEQ ID NOs: 500+595, SEQ ID NOs: 508+603, SEQ ID NOs: 509+604, SEQ ID NOs: 510+605, SEQ ID NOs: 511+606, SEQ ID NOs: 512+607, SEQ ID NOs: 519+614, SEQ ID NOs: 520+615, SEQ ID NOs: 521+616, SEQ ID NOs: 522+617, SEQ ID NOs: 523+618, SEQ ID NOs: 524+619, SEQ ID NOs: 525+620, SEQ ID NOs: 526+621, SEQ ID NOs: 527+622, SEQ ID NOs: 528+623, SEQ ID NOs: 529+624, SEQ ID NOs: 530+625, SEQ ID NOs: 531+626, SEQ ID NOs: 532+627, SEQ ID NOs: 533+628, SEQ ID NOs: 534+629, SEQ ID NOs: 535+630, SEQ ID NOs: 536+631, SEQ ID NOs: 537+632, SEQ ID NOs: 538+633, SEQ ID NOs: 1016+1018, SEQ ID NOs: 1029+1031, SEQ ID NOs: 1042+1044, SEQ ID NOs: 1081+1083, SEQ ID NOs: 1107+1109, SEQ ID NOs: 1120+1122, SEQ ID NOs: 1250+1252, SEQ ID NOs: 1263+1265, SEQ ID NOs: 1276+1278, SEQ ID NOs: 1289+1291, SEQ ID NOs: 1302+1304, SEQ ID NOs: 1654+1656, SEQ ID NOs: 1667+1669, SEQ ID NOs: 1901+1903, SEQ ID NOs: 1914+1916, SEQ ID NOs: 1940+1942, SEQ ID NOs: 1953+1955, SEQ ID NOs: 1966+1968, SEQ ID NOs: 1979+1981, SEQ ID NOs: 1992+1994, SEQ ID NOs: 2005+2007, SEQ ID NOs: 2018+2020, SEQ ID NOs: 2031+2033, SEQ ID NOs: 2044+2046, and SEQ ID NOs: 2057+2059, all pairs grouped into bin 2;

(3) pairs of a VH region and a VL region as depicted in SEQ ID NOs: 338+394, SEQ ID NOs: 354+410, SEQ ID NOs: 378+434, SEQ ID NOs: 356+412, SEQ ID NOs: 476+571, SEQ ID NOs: 477+572, SEQ ID NOs: 478+573, SEQ ID NOs: 479+574, SEQ ID NOs: 480+575, SEQ ID NOs: 481+576, SEQ ID NOs: 482+577, SEQ ID NOs: 483+578, SEQ ID NOs: 484+579, SEQ ID NOs: 501+596, SEQ ID NOs: 502+597, SEQ ID NOs: 503+598, SEQ ID NOs: 504+599, SEQ ID NOs: 505+600, SEQ ID NOs: 506+601, SEQ ID NOs: 517+612, SEQ ID NOs: 518+613, SEQ ID NOs: 1003+1005, SEQ ID NOs: 1055+1057, SEQ ID NOs: 1094+1096, SEQ ID NOs: 1615+1617, SEQ ID NOs: 1628+1630, SEQ ID NOs: 1641+1643, SEQ ID NOs: 1680+1682, SEQ ID NOs: 1693+1695, SEQ ID NOs: 1706+1708, SEQ ID NOs: 1719+1721, SEQ ID NOs: 1732+1734, SEQ ID NOs: 1745+1747, SEQ ID NOs: 1758+1760, SEQ ID NOs: 1771+1773, and SEQ ID NOs: 1927+1929, all pairs grouped into bin 3;

(4) pairs of a VH region and a VL region as depicted in SEQ ID NOs: 352+408, SEQ ID NOs: 360+416, SEQ ID NOs: 388+444, SEQ ID NOs: 386+442, SEQ ID NOs: 340+396, SEQ ID NOs: 346+402, SEQ ID NOs: 374+430, SEQ ID NOs: 348+404, SEQ ID NOs: 390+446, SEQ ID NOs: 463+558, SEQ ID NOs: 464+559, SEQ ID NOs: 465+560, SEQ ID NOs: 466+561, SEQ ID NOs: 467+562, SEQ ID NOs: 468+563, SEQ ID NOs: 469+564, SEQ ID NOs: 470+565, SEQ ID NOs: 471+566, SEQ ID NOs: 472+567, SEQ ID NOs: 473+568, SEQ ID NOs: 474+569, SEQ ID NOs: 475+570, SEQ ID NOs: 488+583, SEQ ID NOs: 489+584, SEQ ID NOs: 490+585, SEQ ID NOs: 491+586, SEQ ID NOs: 513+608, SEQ ID NOs: 514+609, SEQ ID NOs: 515+610, SEQ ID NOs: 516+611, SEQ ID NOs: 540+635, SEQ ID NOs: 541+636, SEQ ID NOs: 542+637, SEQ ID NOs: 543+638, SEQ ID NOs: 977+979, SEQ ID NOs: 1068+1070, SEQ ID NOs: 1146+1148, SEQ ID NOs: 1159+1161, SEQ ID NOs: 1185+1187, SEQ ID NOs: 1198+1200, SEQ ID NOs: 1211+1213, SEQ ID NOs: 1224+1226, SEQ ID NOs: 1237+1239, SEQ ID NOs: 1315+1317, SEQ ID NOs: 1328+1330, SEQ ID NOs: 1380+1382 SEQ ID NOs: 1393+1395, SEQ ID NOs: 1406+1408, SEQ ID NOs: 1419+1421, SEQ ID NOs: 1469+1471, SEQ ID NOs: 1478+1480, SEQ ID NOs: 1485+1487, SEQ ID NOs: 1494+1496, SEQ ID NOs: 1501+1503, SEQ ID NOs: 1508+1510, SEQ ID NOs: 1519+1521, SEQ ID NOs: 1526+1528, SEQ ID NOs: 1533+1535, SEQ ID NOs: 1542+1544, SEQ ID NOs: 1549+1551, SEQ ID NOs: 1558+1560, SEQ ID NOs: 1565+1567, SEQ ID NOs: 1784+1786, SEQ ID NOs: 1797+1799, SEQ ID NOs: 1810+1812, SEQ ID NOs: 1823+1825, SEQ ID NOs: 1836+1838, SEQ ID NOs: 1849+1851, SEQ ID NOs: 1862+1864, SEQ ID NOs: 1875+1877, SEQ ID NOs: 1888+1890, SEQ ID NOs: 2070+2072, SEQ ID NOs: 2083+2085, SEQ ID NOs: 2096+2098, SEQ ID NOs: 2109+2111, SEQ ID NOs: 2122+2124, SEQ ID NOs: 2135+2137, SEQ ID NOs: 2148+2150, SEQ ID NOs: 2161+2163, SEQ ID NOs: 2187+2189, SEQ ID NOs: 2200+2202, and SEQ ID NOs: 2213+2215, all pairs grouped into bin 4; and (5) pairs of a VH region and a VL region as depicted in SEQ ID NOs: 376+432, SEQ ID NOs: 392+448, SEQ ID NOs: 358+414, SEQ ID NOs: 350+406, SEQ ID NOs: 507+602, SEQ ID NOs: 990+992, SEQ ID NOs: 1589+1591, and SEQ ID NOs: 1602+1604, all pairs grouped into bin 5.

In a further embodiment of the invention the antibody construct is in a format selected from the group consisting of (scFv)$_2$, (single domain mAb)$_2$, scFv-single domain mAb, diabodies and oligomers thereof.

In a preferred embodiment the first binding domain comprises an amino acid selected from the group consisting of
(a) as depicted in SEQ ID NO: 117, SEQ ID NO: 1137, SEQ ID NO: 1176, SEQ ID NO: 1345, SEQ ID NO: 1358, SEQ ID NO: 1371, SEQ ID NO: 1436, SEQ ID NO: 1449 and SEQ ID NO: 2178, all binders grouped into bin 1;
(b) as depicted in SEQ ID NO: 1020, SEQ ID NO: 1033, SEQ ID NO: 1046, SEQ ID NO: 1085, SEQ ID NO: 1111, SEQ ID NO: 1124, SEQ ID NO: 1254, SEQ ID NO: 1267, SEQ ID NO: 1280, SEQ ID NO: 1293, SEQ ID NO: 1306, SEQ ID NO: 1658, SEQ ID NO: 1671, SEQ ID NO: 1905, SEQ ID NO: 1918, SEQ ID NO: 1944, SEQ ID NO: 1957, SEQ ID NO: 1970, SEQ ID NO: 1983, SEQ ID NO: 1996, SEQ ID NO: 2009, SEQ ID NO: 2022, SEQ ID NO: 2035, SEQ ID NO: 2048, and SEQ ID NO: 2061, all binders grouped into bin 2;
(c) as depicted in SEQ ID NO: 1007, SEQ ID NO: 1059, SEQ ID NO: 1098, SEQ ID NO: 1619, SEQ ID NO: 1632, SEQ ID NO: 1645, SEQ ID NO: 1684, SEQ ID NO: 1697, SEQ ID NO: 1710, SEQ ID NO: 1723, SEQ ID NO: 1736, SEQ ID NO: 1749, SEQ ID NO: 1762, SEQ ID NO: 1775, and SEQ ID NO: 1931, all binders grouped into bin 3;
(d) as depicted in SEQ ID NO: 981, SEQ ID NO: 1072, SEQ ID NO: 1150, SEQ ID NO: 1163, SEQ ID NO: 1189, SEQ ID NO: 1202, SEQ ID NO: 1215, SEQ ID NO: 1228, SEQ ID NO: 1241, SEQ ID NO: 1319, SEQ ID NO: 1332, SEQ ID NO: 1384, SEQ ID NO: 1397, SEQ ID NO: 1410, SEQ ID NO: 1423, SEQ ID NO: 1473, SEQ ID NO: 1482, SEQ ID NO: 1489, SEQ ID NO: 1498, SEQ ID NO: 1505, SEQ ID NO: 1512, SEQ ID NO: 1523, SEQ ID NO: 1530, SEQ ID NO: 1537, SEQ ID NO: 1546, SEQ ID NO: 1553, SEQ ID NO: 1562, SEQ ID NO: 1569, SEQ ID NO: 1788, SEQ ID NO: 1801, SEQ ID NO: 1814, SEQ ID NO: 1827, SEQ ID NO: 1840, SEQ ID NO: 1853, SEQ ID NO: 1866, SEQ ID NO: 1879, SEQ ID NO: 1892, SEQ ID NO: 2074, SEQ ID NO: 2087, SEQ ID NO: 2100, SEQ ID NO: 2113, SEQ ID NO: 2126, SEQ ID NO: 2139, SEQ ID NO: 2152, SEQ ID NO: 2165, SEQ ID NO: 2191, SEQ ID NO: 2204, and SEQ ID NO: 2217, all binders grouped into bin 4; and
(e) as depicted in SEQ ID NO: 994, SEQ ID NO: 1593, and SEQ ID NO: 1606, grouped into bin 5;

In one aspect of the invention, the second binding domain is capable of binding to human CD3 and to macaque CD3, preferably to human CD3 epsilon and to macaque CD3 epsilon. Additionally or alternatively, the second binding domain is capable of binding to *Callithrix jacchus*, *Saguinus oedipus* and/or *Saimiri sciureus* CD3 epsilon. According to these embodiments, one or both binding domains of the antibody construct of the invention are preferably cross-species specific for members of the mammalian order of primates. Cross-species specific CD3 binding domains are, for example, described in WO 2008/119567.

It is particularly preferred for the antibody construct of the present invention that the second binding domain capable of binding to the T cell CD3 receptor complex comprises a VL region comprising CDR-L1, CDR-L2 and CDR-L3 selected from:

(a) CDR-L1 as depicted in SEQ ID NO: 27 of WO 2008/119567, CDR-L2 as depicted in SEQ ID NO: 28 of WO 2008/119567 and CDR-L3 as depicted in SEQ ID NO: 29 of WO 2008/119567;
(b) CDR-L1 as depicted in SEQ ID NO: 117 of WO 2008/119567, CDR-L2 as depicted in SEQ ID NO: 118 of WO 2008/119567 and CDR-L3 as depicted in SEQ ID NO: 119 of WO 2008/119567; and
(c) CDR-L1 as depicted in SEQ ID NO: 153 of WO 2008/119567, CDR-L2 as depicted in SEQ ID NO: 154 of WO 2008/119567 and CDR-L3 as depicted in SEQ ID NO: 155 of WO 2008/119567.

In an alternatively preferred embodiment of the antibody construct of the present invention, the second binding domain capable of binding to the T cell CD3 receptor complex comprises a VH region comprising CDR-H 1, CDR-H2 and CDR-H3 selected from:
(a) CDR-H1 as depicted in SEQ ID NO: 12 of WO 2008/119567, CDR-H2 as depicted in SEQ ID NO: 13 of WO 2008/119567 and CDR-H3 as depicted in SEQ ID NO: 14 of WO 2008/119567;
(b) CDR-H1 as depicted in SEQ ID NO: 30 of WO 2008/119567, CDR-H2 as depicted in SEQ ID NO: 31 of WO 2008/119567 and CDR-H3 as depicted in SEQ ID NO: 32 of WO 2008/119567;
(c) CDR-H1 as depicted in SEQ ID NO: 48 of WO 2008/119567, CDR-H2 as depicted in SEQ ID NO: 49 of WO 2008/119567 and CDR-H3 as depicted in SEQ ID NO: 50 of WO 2008/119567;
(d) CDR-H1 as depicted in SEQ ID NO: 66 of WO 2008/119567, CDR-H2 as depicted in SEQ ID NO: 67 of WO 2008/119567 and CDR-H3 as depicted in SEQ ID NO: 68 of WO 2008/119567;
(e) CDR-H1 as depicted in SEQ ID NO: 84 of WO 2008/119567, CDR-H2 as depicted in SEQ ID NO: 85 of WO 2008/119567 and CDR-H3 as depicted in SEQ ID NO: 86 of WO 2008/119567;
(f) CDR-H1 as depicted in SEQ ID NO: 102 of WO 2008/119567, CDR-H2 as depicted in SEQ ID NO: 103 of WO 2008/119567 and CDR-H3 as depicted in SEQ ID NO: 104 of WO 2008/119567;
(g) CDR-H1 as depicted in SEQ ID NO: 120 of WO 2008/119567, CDR-H2 as depicted in SEQ ID NO: 121 of WO 2008/119567 and CDR-H3 as depicted in SEQ ID NO: 122 of WO 2008/119567;
(h) CDR-H1 as depicted in SEQ ID NO: 138 of WO 2008/119567, CDR-H2 as depicted in SEQ ID NO: 139 of WO 2008/119567 and CDR-H3 as depicted in SEQ ID NO: 140 of WO 2008/119567;
(i) CDR-H1 as depicted in SEQ ID NO: 156 of WO 2008/119567, CDR-H2 as depicted in SEQ ID NO: 157 of WO 2008/119567 and CDR-H3 as depicted in SEQ ID NO: 158 of WO 2008/119567; and
(j) CDR-H1 as depicted in SEQ ID NO: 174 of WO 2008/119567, CDR-H2 as depicted in SEQ ID NO: 175 of WO 2008/119567 and CDR-H3 as depicted in SEQ ID NO: 176 of WO 2008/119567.

It is further preferred for the antibody construct of the present invention that the second binding domain capable of binding to the T cell CD3 receptor complex comprises a VL region selected from the group consisting of a VL region as depicted in SEQ ID NO: 35, 39, 125, 129, 161 or 165 of WO 2008/119567.

It is alternatively preferred that the second binding domain capable of binding to the T cell CD3 receptor complex comprises a VH region selected from the group consisting of a VH region as depicted in SEQ ID NO: 15, 19, 33, 37, 51, 55, 69, 73, 87, 91, 105, 109, 123, 127, 141, 145, 159, 163, 177 or 181 of WO 2008/119567.

More preferably, the antibody construct of the present invention is characterized by the second binding domain capable of binding to the T cell CD3 receptor complex comprising a VL region and a VH region selected from the group consisting of:
(a) a VL region as depicted in SEQ ID NO: 17 or 21 of WO 2008/119567 and a VH region as depicted in SEQ ID NO: 15 or 19 of WO 2008/119567;
(b) a VL region as depicted in SEQ ID NO: 35 or 39 of WO 2008/119567 and a VH region as depicted in SEQ ID NO: 33 or 37 of WO 2008/119567;
(c) a VL region as depicted in SEQ ID NO: 53 or 57 of WO 2008/119567 and a VH region as depicted in SEQ ID NO: 51 or 55 of WO 2008/119567;
(d) a VL region as depicted in SEQ ID NO: 71 or 75 of WO 2008/119567 and a VH region as depicted in SEQ ID NO: 69 or 73 of WO 2008/119567;
(e) a VL region as depicted in SEQ ID NO: 89 or 93 of WO 2008/119567 and a VH region as depicted in SEQ ID NO: 87 or 91 of WO 2008/119567;
(f) a VL region as depicted in SEQ ID NO: 107 or 111 of WO 2008/119567 and a VH region as depicted in SEQ ID NO: 105 or 109 of WO 2008/119567;
(g) a VL region as depicted in SEQ ID NO: 125 or 129 of WO 2008/119567 and a VH region as depicted in SEQ ID NO: 123 or 127 of WO 2008/119567;
(h) a VL region as depicted in SEQ ID NO: 143 or 147 of WO 2008/119567 and a VH region as depicted in SEQ ID NO: 141 or 145 of WO 2008/119567;
(i) a VL region as depicted in SEQ ID NO: 161 or 165 of WO 2008/119567 and a VH region as depicted in SEQ ID NO: 159 or 163 of WO 2008/119567; and
(j) a VL region as depicted in SEQ ID NO: 179 or 183 of WO 2008/119567 and a VH region as depicted in SEQ ID NO: 177 or 181 of WO 2008/119567.

According to a preferred embodiment of the antibody construct of the present invention, in particular the second binding domain capable of binding to the T cell CD3 receptor complex, the pairs of VH-regions and VL-regions are in the format of a single chain antibody (scFv). The VH and VL regions are arranged in the order VH-VL or VL-VH. It is preferred that the VH-region is positioned N-terminally to a linker sequence. The VL-region is positioned C-terminally of the linker sequence.

A preferred embodiment of the above described antibody construct of the present invention is characterized by the second binding domain capable of binding to the T cell CD3 receptor complex comprising an amino acid sequence selected from the group consisting of SEQ ID NOs: 23, 25, 41, 43, 59, 61, 77, 79, 95, 97, 113, 115, 131, 133, 149, 151, 167, 169, 185 or 187 of WO 2008/119567.

In a preferred embodiment the antibody construct of the invention has an amino acid sequence selected from the group consisting of
(a) as depicted in SEQ ID NO: 1138, SEQ ID NO: 1177, SEQ ID NO: 1346, SEQ ID NO: 1359, SEQ ID NO: 1372, SEQ ID NO: 1437, SEQ ID NO: 1450 and SEQ ID NO: 2179;
(b) as depicted in SEQ ID NO: 1021, SEQ ID NO: 1034, SEQ ID NO: 1047, SEQ ID NO: 1086, SEQ ID NO: 1112, SEQ ID NO: 1125, SEQ ID NO: 1255, SEQ ID NO: 1268, SEQ ID NO: 1281, SEQ ID NO: 1294, SEQ ID NO: 1307, SEQ ID NO: 1659, SEQ ID NO: 1672, SEQ ID NO: 1906, SEQ ID NO: 1919, SEQ ID NO: 1945, SEQ ID NO: 1958, SEQ ID NO: 1971, SEQ ID NO: 1984, SEQ ID NO: 1997, SEQ ID NO: 2010, SEQ ID NO: 2023, SEQ ID NO: 2036, SEQ ID NO: 2049, and SEQ ID NO: 2062;
(c) as depicted in SEQ ID NO: 1008, SEQ ID NO: 1060, SEQ ID NO: 1099, SEQ ID NO: 1620, SEQ ID NO: 1633, SEQ ID NO: 1646, SEQ ID NO: 1685, SEQ ID NO: 1698, SEQ ID NO: 1711, SEQ ID NO: 1724, SEQ ID NO: 1737, SEQ ID NO: 1750, SEQ ID NO: 1763, SEQ ID NO: 1776, and SEQ ID NO: 1932;
(d) as depicted in SEQ ID NO: 982, SEQ ID NO: 1073, SEQ ID NO: 1151, SEQ ID NO: 1164, SEQ ID NO: 1190, SEQ ID NO: 1203, SEQ ID NO: 1216, SEQ ID NO: 1229, SEQ ID NO: 1242, SEQ ID NO: 1320, SEQ ID NO: 1333, SEQ ID NO: 1385, SEQ ID NO: 1398, SEQ ID NO: 1411, SEQ ID NO: 1424, SEQ ID NO: 1474, SEQ ID NO: 1475, SEQ ID NO: 1476, SEQ ID NO: 1483, SEQ ID NO: 1490, SEQ ID NO: 1491, SEQ ID NO: 1492, SEQ ID NO: 1499, SEQ ID NO: 1506, SEQ ID NO: 1513, SEQ ID NO: 1514, SEQ ID NO: 1515, SEQ ID NO: 1516, SEQ ID NO: 1517, SEQ ID NO: 1524, SEQ ID NO: 1531, SEQ ID NO: 1538, SEQ ID NO: 1539, SEQ ID NO: 1540, SEQ ID NO: 1547, SEQ ID NO: 1554, SEQ ID NO: 1555, SEQ ID NO: 1556, SEQ ID NO: 1563, SEQ ID NO: 1570, SEQ ID NO: 1571, SEQ ID NO: 1572, SEQ ID NO: 1573, SEQ ID NO: 1574, SEQ ID NO: 1575, SEQ ID NO: 1576, SEQ ID NO: 1577, SEQ ID NO: 1578, SEQ ID NO: 1579, SEQ ID NO: 1580, SEQ ID NO: 1581, SEQ ID NO: 1789, SEQ ID NO: 1802, SEQ ID NO: 1815, SEQ ID NO: 1828, SEQ ID NO: 1841, SEQ ID NO: 1854, SEQ ID NO: 1867, SEQ ID NO: 1880, SEQ ID NO: 1893, SEQ ID NO: 2075, SEQ ID NO: 2088, SEQ ID NO: 2101, SEQ ID NO: 2114, SEQ ID NO: 2127, SEQ ID NO: 2140, SEQ ID NO: 2153, SEQ ID NO: 2166, SEQ ID NO: 2192, SEQ ID NO: 2205, and SEQ ID NO: 2218 to 2228; and
(e) as depicted in SEQ ID NO: 995, SEQ ID NO: 1594, and SEQ ID NO: 1607.

The invention further provides a nucleic acid sequence encoding an antibody construct of the invention.

Furthermore, the invention provides a vector comprising a nucleic acid sequence of the invention. Moreover, the invention provides a host cell transformed or transfected with the nucleic acid sequence of the invention.

In a further embodiment the invention provides a process for the production of a antibody construct of the invention, said process comprising culturing a host cell of the invention under conditions allowing the expression of the antibody construct of the invention and recovering the produced antibody construct from the culture.

Moreover, the invention provides a pharmaceutical composition comprising an antibody construct of the invention or produced according to the process of the invention The formulations described herein are useful as pharmaceutical compositions in the treatment, amelioration and/or prevention of the pathological medical condition as described herein in a patient in need thereof. The term "treatment" refers to both therapeutic treatment and prophylactic or preventative measures. Treatment includes the application or administration of the formulation to the body, an isolated tissue, or cell from a patient who has a disease/disorder, a symptom of a disease/disorder, or a predisposition toward a disease/disorder, with the purpose to cure, heal, alleviate, relieve, alter, remedy, ameliorate, improve, or affect the disease, the symptom of the disease, or the predisposition toward the disease.

Those "in need of treatment" include those already with the disorder, as well as those in which the disorder is to be prevented. The term "disease" is any condition that would benefit from treatment with the protein formulation described herein. This includes chronic and acute disorders or diseases including those pathological conditions that predispose the mammal to the disease in question. Non-limiting examples of diseases/disorders to be treated herein include proliferative disease, a tumorous disease, or an immunological disorder.

In some embodiments, the invention provides a pharmaceutical composition comprising a therapeutically effective amount of one or a plurality of the antibody construct of the invention together with a pharmaceutically effective diluents, carrier, solubilizer, emulsifier, preservative, and/or adjuvant. Pharmaceutical compositions of the invention include, but are not limited to, liquid, frozen, and lyophilized compositions.

Preferably, formulation materials are nontoxic to recipients at the dosages and concentrations employed. In specific embodiments, pharmaceutical compositions comprising a therapeutically effective amount of an antibody construct of the invention.

In certain embodiments, the pharmaceutical composition may contain formulation materials for modifying, maintaining or preserving, for example, the pH, osmolarity, viscosity, clarity, color, isotonicity, odor, sterility, stability, rate of dissolution or release, adsorption or penetration of the composition. In such embodiments, suitable formulation materials include, but are not limited to, amino acids (such as glycine, glutamine, asparagine, arginine, proline, or lysine); antimicrobials; antioxidants (such as ascorbic acid, sodium sulfite or sodium hydrogen-sulfite); buffers (such as borate, bicarbonate, Tris-HCl, citrates, phosphates or other organic acids); bulking agents (such as mannitol or glycine); chelating agents (such as ethylenediamine tetraacetic acid (EDTA)); complexing agents (such as caffeine, polyvinylpyrrolidone, beta-cyclodextrin or hydroxypropyl-beta-cyclodextrin); fillers; monosaccharides; disaccharides; and other carbohydrates (such as glucose, mannose or dextrins); proteins (such as serum albumin, gelatin or immunoglobulins); coloring, flavoring and diluting agents; emulsifying agents; hydrophilic polymers (such as polyvinylpyrrolidone); low molecular weight polypeptides; salt-forming counterions (such as sodium); preservatives (such as benzalkonium chloride, benzoic acid, salicylic acid, thimerosal, phenethyl alcohol, methylparaben, propylparaben, chlorhexidine, sorbic acid or hydrogen peroxide); solvents (such as glycerin, propylene glycol or polyethylene glycol); sugar alcohols (such as mannitol or sorbitol); suspending agents; surfactants or wetting agents (such as pluronics, PEG, sorbitan esters, polysorbates such as polysorbate 20, polysorbate, triton, tromethamine, lecithin, cholesterol, tyloxapal); stability enhancing agents (such as sucrose or sorbitol); tonicity enhancing agents (such as alkali metal halides, preferably sodium or potassium chloride, mannitol sorbitol); delivery vehicles; diluents; excipients and/or pharmaceutical adjuvants. See, REMINGTON'S PHARMACEUTICAL SCIENCES, 18" Edition, (A. R. Genrmo, ed.), 1990, Mack Publishing Company.

In certain embodiments, the optimal pharmaceutical composition will be determined by one skilled in the art depending upon, for example, the intended route of administration, delivery format and desired dosage. See, for example, REMINGTON'S PHARMACEUTICAL SCIENCES, supra. In certain embodiments, such compositions may influence the physical state, stability, rate of in vivo release and rate of in vivo clearance of the antigen binding proteins of the invention. In certain embodiments, the primary vehicle or carrier in a pharmaceutical composition may be either aqueous or non-aqueous in nature. For example, a suitable vehicle or carrier may be water for injection, physiological saline solution or artificial cerebrospinal fluid, possibly supplemented with other materials common in compositions for parenteral administration. Neutral buffered saline or saline mixed with serum albumin are further exemplary vehicles. In specific embodiments, pharmaceutical compositions comprise Tris buffer of about pH 7.0-8.5, or acetate buffer of about pH 4.0-5.5, and may further include sorbitol or a suitable substitute therefore. In certain embodiments of the invention, human antibody or antigen binding fragment thereof of the invention or the antibody construct of the invention compositions may be prepared for storage by mixing the selected composition having the desired degree of purity with optional formulation agents (REMINGTON'S PHARMACEUTICAL SCIENCES, supra) in the form of a lyophilized cake or an aqueous solution. Further, in certain embodiments, the human antibody or antigen binding fragment thereof of the invention or the antibody construct of the invention may be formulated as a lyophilizate using appropriate excipients such as sucrose.

The pharmaceutical compositions of the invention can be selected for parenteral delivery. Alternatively, the compositions may be selected for inhalation or for delivery through the digestive tract, such as orally. Preparation of such pharmaceutically acceptable compositions is within the skill of the art. The formulation components are present preferably in concentrations that are acceptable to the site of administration. In certain embodiments, buffers are used to maintain the composition at physiological pH or at a slightly lower pH, typically within a pH range of from about 5 to about 8.

When parenteral administration is contemplated, the therapeutic compositions for use in this invention may be provided in the form of a pyrogen-free, parenterally acceptable aqueous solution comprising the desired human antibody or antigen binding fragment thereof of the invention or the antibody construct of the invention in a pharmaceutically acceptable vehicle. A particularly suitable vehicle for parenteral injection is sterile distilled water in which the antibody construct of the invention is formulated as a sterile, isotonic solution, properly preserved. In certain embodiments, the preparation can involve the formulation of the desired molecule with an agent, such as injectable microspheres, bio-erodible particles, polymeric compounds (such as polylactic acid or polyglycolic acid), beads or liposomes, that may provide controlled or sustained release of the product which can be delivered via depot injection. In certain embodiments, hyaluronic acid may also be used, having the effect of promoting sustained duration in the circulation. In certain embodiments, implantable drug delivery devices may be used to introduce the desired antigen binding protein.

Additional pharmaceutical compositions will be evident to those skilled in the art, including formulations involving h the antibody construct of the invention in sustained- or controlled-delivery formulations. Techniques for formulating a variety of other sustained- or controlled-delivery means, such as liposome carriers, bio-erodible microparticles or porous beads and depot injections, are also known to those skilled in the art. See, for example, International Patent Application No. PCT/US93/00829, which is incorporated by reference and describes controlled release of porous polymeric microparticles for delivery of pharmaceutical compositions. Sustained-release preparations may include semipermeable polymer matrices in the form of shaped articles, e.g., films, or microcapsules. Sustained release matrices may include polyesters, hydrogels, poly- lactides (as disclosed in U.S. Pat. No. 3,773,919 and European Patent Application Publication No. EP 058481, each of which is incorporated by reference), copolymers of L-glutamic acid and gamma ethyl-L-glutamate (Sidman et al., 1983, Biopolymers 2:547-556), poly(2-hydroxyethyl-methacrylate) (Langer et al., 1981, J. Biomed. Mater. Res. 15:167-277 and Langer, 1982, Chem. Tech. 12:98-105), ethylene vinyl acetate (Langer et al., 1981, supra) or poly-D(-)-3-hydroxybutyric acid (European Patent Application Publication No. EP 133,988). Sustained release compositions may also include liposomes that can be prepared by any of several methods known in the art. See, e.g., Eppstein et al., 1985, Proc. Natl. Acad. Sci. U.S.A. 82:3688-3692; European Patent Application Publication Nos. EP 036,676; EP 088,046 and EP 143,949, incorporated by reference.

Pharmaceutical compositions used for in vivo administration are typically provided as sterile preparations. Sterilization can be accomplished by filtration through sterile filtration membranes. When the composition is lyophilized, sterilization using this method may be conducted either prior to or following lyophilization and reconstitution. Compositions for parenteral administration can be stored in lyophilized form or in a solution. Parenteral compositions generally are placed into a container having a sterile access port, for example, an intravenous solution bag or vial having a stopper pierceable by a hypodermic injection needle.

Aspects of the invention includes self-buffering antibody construct of the invention formulations, which can be used as pharmaceutical compositions, as described in international patent application WO 06138181A2 (PCT/US2006/022599), which is incorporated by reference in its entirety herein.

As discussed above, certain embodiments provide antibody construct of the invention protein compositions, particularly pharmaceutical compositions of the invention, that comprise, in addition to the antibody construct of the invention, one or more excipients such as those illustratively described in this section and elsewhere herein. Excipients can be used in the invention in this regard for a wide variety of purposes, such as adjusting physical, chemical, or biological properties of formulations, such as adjustment of viscosity, and or processes of the invention to improve effectiveness and or to stabilize such formulations and processes against degradation and spoilage due to, for instance, stresses that occur during manufacturing, shipping, storage, pre-use preparation, administration, and thereafter. A variety of expositions are available on protein stabilization and formulation materials and methods useful in this regard, such as Arakawa et al., "Solvent interactions in pharmaceutical formulations," Pharm Res. 8(3): 285-91 (1991); Kendrick et al., "Physical stabilization of proteins in aqueous solution," in: RATIONAL DESIGN OF STABLE PROTEIN FORMULATIONS: THEORY AND PRACTICE, Carpenter and Manning, eds. Pharmaceutical Biotechnology. 13: 61-84 (2002), and Randolph et al., "Surfactant-protein interactions," Pharm Biotechnol. 13: 159-75 (2002), each of which is herein incorporated by reference in its entirety, particularly in parts pertinent to excipients and processes of the same for self-buffering protein formulations in accordance with the current invention, especially as to protein pharmaceutical products and processes for veterinary and/or human medical uses.

Salts may be used in accordance with certain embodiments of the invention to, for example, adjust the ionic strength and/or the isotonicity of a formulation and/or to improve the solubility and/or physical stability of a protein or other ingredient of a composition in accordance with the invention.

As is well known, ions can stabilize the native state of proteins by binding to charged residues on the protein's surface and by shielding charged and polar groups in the protein and reducing the strength of their electrostatic interactions, attractive, and repulsive interactions. Ions also can stabilize the denatured state of a protein by binding to, in particular, the denatured peptide linkages (—CONH) of the protein. Furthermore, ionic interaction with charged and polar groups in a protein also can reduce intermolecular electrostatic interactions and, thereby, prevent or reduce protein aggregation and insolubility.

Ionic species differ significantly in their effects on proteins. A number of categorical rankings of ions and their effects on proteins have been developed that can be used in formulating pharmaceutical compositions in accordance with the invention. One example is the Hofmeister series, which ranks ionic and polar non-ionic solutes by their effect on the conformational stability of proteins in solution. Stabilizing solutes are referred to as "kosmotropic." Destabilizing solutes are referred to as "chaotropic." Kosmotropes commonly are used at high concentrations (e.g., >1 molar ammonium sulfate) to precipitate proteins from solution ("salting-out"). Chaotropes commonly are used to denture and/or to solubilize proteins ("salting-in"). The relative effectiveness of ions to "salt-in" and "salt-out" defines their position in the Hofmeister series.

Free amino acids can be used in the antibody construct of the invention formulations in accordance with various embodiments of the invention as bulking agents, stabilizers, and antioxidants, as well as other standard uses. Lysine, proline, serine, and alanine can be used for stabilizing proteins in a formulation. Glycine is useful in lyophilization to ensure correct cake structure and properties. Arginine may be useful to inhibit protein aggregation, in both liquid and lyophilized formulations. Methionine is useful as an antioxidant.

Polyols include sugars, e.g., mannitol, sucrose, and sorbitol and polyhydric alcohols such as, for instance, glycerol and propylene glycol, and, for purposes of discussion herein, polyethylene glycol (PEG) and related substances. Polyols are kosmotropic. They are useful stabilizing agents in both liquid and lyophilized formulations to protect proteins from physical and chemical degradation processes. Polyols also are useful for adjusting the tonicity of formulations.

Among polyols useful in select embodiments of the invention is mannitol, commonly used to ensure structural stability of the cake in lyophilized formulations. It ensures structural stability to the cake. It is generally used with a lyoprotectant, e.g., sucrose. Sorbitol and sucrose are among preferred agents for adjusting tonicity and as stabilizers to protect against freeze-thaw stresses during transport or the preparation of bulks during the manufacturing process. Reducing sugars (which contain free aldehyde or ketone groups), such as glucose and lactose, can glycate surface lysine and arginine residues. Therefore, they generally are not among preferred polyols for use in accordance with the invention. In addition, sugars that form such reactive species, such as sucrose, which is hydrolyzed to fructose and glucose under acidic conditions, and consequently engenders glycation, also is not among preferred polyols of the invention in this regard. PEG is useful to stabilize proteins and as a cryoprotectant and can be used in the invention in this regard.

Embodiments of the antibody construct of the invention formulations further comprise surfactants. Protein molecules may be susceptible to adsorption on surfaces and to denaturation and consequent aggregation at air-liquid, solid-liquid, and liquid-liquid interfaces. These effects generally scale inversely with protein concentration. These deleterious interactions generally scale inversely with protein concentration and typically are exacerbated by physical agitation, such as that generated during the shipping and handling of a product.

Surfactants routinely are used to prevent, minimize, or reduce surface adsorption. Useful surfactants in the invention in this regard include polysorbate 20, polysorbate 80, other fatty acid esters of sorbitan polyethoxylates, and poloxamer 188.

Surfactants also are commonly used to control protein conformational stability. The use of surfactants in this regard is protein-specific since, any given surfactant typically will stabilize some proteins and destabilize others.

Polysorbates are susceptible to oxidative degradation and often, as supplied, contain sufficient quantities of peroxides to cause oxidation of protein residue side-chains, especially methionine. Consequently, polysorbates should be used carefully, and when used, should be employed at their lowest effective concentration. In this regard, polysorbates exemplify the general rule that excipients should be used in their lowest effective concentrations.

Embodiments of the antibody construct of the invention formulations further comprise one or more antioxidants. To some extent deleterious oxidation of proteins can be prevented in pharmaceutical formulations by maintaining proper levels of ambient oxygen and temperature and by avoiding exposure to light. Antioxidant excipients can be used as well to prevent oxidative degradation of proteins. Among useful antioxidants in this regard are reducing agents, oxygen/free-radical scavengers, and chelating agents. Antioxidants for use in therapeutic protein formulations in accordance with the invention preferably are water-soluble and maintain their activity throughout the shelf life of a product. EDTA is a preferred antioxidant in accordance with the invention in this regard.

Antioxidants can damage proteins. For instance, reducing agents, such as glutathione in particular, can disrupt intramolecular disulfide linkages. Thus, antioxidants for use in the invention are selected to, among other things, eliminate or sufficiently reduce the possibility of themselves damaging proteins in the formulation.

Formulations in accordance with the invention may include metal ions that are protein co-factors and that are necessary to form protein coordination complexes, such as zinc necessary to form certain insulin suspensions. Metal ions also can inhibit some processes that degrade proteins. However, metal ions also catalyze physical and chemical processes that degrade proteins.

Magnesium ions (10-120 mM) can be used to inhibit isomerization of aspartic acid to isoaspartic acid. $Ca^{+2}$ ions (up to 100 mM) can increase the stability of human deoxyribonuclease. $Mg^{+2}$, $Mn^{+2}$, and $Zn^{+2}$, however, can destabilize rhDNase. Similarly, $Ca^{+2}$ and $Sr^{+2}$ can stabilize Factor VIII, it can be destabilized by $Mg^{+2}$, $Mn^{+2}$ and $Zn^{+2}$, $Cu^{+2}$ and $Fe^{+2}$, and its aggregation can be increased by $Al^{+3}$ ions.

Embodiments of the antibody construct of the invention formulations further comprise one or more preservatives. Preservatives are necessary when developing multi-dose parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use with small-molecule parenterals, the development of protein formulations that includes preservatives can be challenging. Preservatives almost always have a destabilizing effect (aggregation) on proteins, and this has become a major factor in limiting their use in multi-dose protein formulations. To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin (liquid, Novo Nordisk), Nutropin AQ (liquid, Genentech) & Genotropin (lyophilized—dual chamber cartridge, Pharmacia & Upjohn) contain phenol while Somatrope (Eli Lilly) is formulated with m-cresol. Several aspects need to be considered during the formulation and development of preserved dosage forms. The effective preservative concentration in the drug product must be optimized. This requires testing a given preservative in the dosage form with concentration ranges that confer anti-microbial effectiveness without compromising protein stability.

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein, significantly minimizing the associated stability risks. With liquid formulations, preservative effectiveness and stability should be maintained over the entire product shelf-life (about 18 to 24 months). An important point to note is that preservative effectiveness should be demonstrated in the final formulation containing the active drug and all excipient components.

The antibody construct of the invention generally will be designed for specific routes and methods of administration, for specific administration dosages and frequencies of administration, for specific treatments of specific diseases, with ranges of bio-availability and persistence, among other things. Formulations thus may be designed in accordance with the invention for delivery by any suitable route, including but not limited to orally, aurally, opthalmically, rectally, and vaginally, and by parenteral routes, including intravenous and intraarterial injection, intramuscular injection, and subcutaneous injection.

Once the pharmaceutical composition has been formulated, it may be stored in sterile vials as a solution, suspension, gel, emulsion, solid, crystal, or as a dehydrated or lyophilized powder. Such formulations may be stored either in a ready-to-use form or in a form (e.g., lyophilized) that is reconstituted prior to administration. The invention also provides kits for producing a single-dose administration unit. The kits of the invention may each contain both a first container having a dried protein and a second container having an aqueous formulation. In certain embodiments of this invention, kits containing single and multi-chambered pre-filled syringes (e.g., liquid syringes and lyosyringes) are provided. The therapeutically effective amount of an antibody construct of the invention protein-containing pharmaceutical composition to be employed will depend, for example, upon the therapeutic context and objectives. One skilled in the art will appreciate that the appropriate dosage levels for treatment will vary depending, in part, upon the molecule delivered, the indication for which the antibody construct of the invention is being used, the route of administration, and the size (body weight, body surface or organ size) and/or condition (the age and general health) of the patient. In certain embodiments, the clinician may titer the dosage and modify the route of administration to obtain the optimal therapeutic effect. A typical dosage may range from about 0.1 µg/kg to up to about 30 mg/kg or more, depending on the factors mentioned above. In specific embodiments, the dosage may range from 1.0 µg/kg up to about 20 mg/kg, optionally from 10 µg/kg up to about 10 mg/kg or from 100 µg/kg up to about 5 mg/kg.

A therapeutic effective amount of an antibody construct of the invention preferably results in a decrease in severity of disease symptoms, in increase in frequency or duration of disease symptom-free periods or a prevention of impairment or disability due to the disease affliction. For treating CDH19-expressing tumors, a therapeutically effective amount of the antibody construct of the invention, e.g. an anti-CDH19/CD3 antibody construct, preferably inhibits cell growth or tumor growth by at least about 20%, at least about 40%, at least about 50%, at least about 60%, at least about 70%, at least about 80%, or at least about 90% relative to untreated patients. The ability of a compound to inhibit tumor growth may be evaluated in an animal model predictive of efficacy in human tumors.

Pharmaceutical compositions may be administered using a medical device. Examples of medical devices for administering pharmaceutical compositions are described in U.S. Pat. Nos. 4,475,196; 4,439,196; 4,447,224; 4,447, 233; 4,486,194; 4,487,603; 4,596,556; 4,790,824; 4,941,880; 5,064,413; 5,312,335; 5,312,335; 5,383,851; and 5,399,163, all incorporated by reference herein.

In one embodiment the invention provides the antibody construct of the invention or produced according to the process of the invention for use in the prevention, treatment or amelioration of a melanoma disease or metastatic melanoma disease.

The invention also provides a method for the treatment or amelioration of a melanoma disease or metastatic melanoma disease, comprising the step of administering to a subject in need thereof the antibody construct of the invention or produced according to the process of the invention.

In a preferred embodiment method of use of the invention the melanoma disease or metastatic melanoma disease is selected from the group consisting of superficial spreading melanoma, lentigo maligna, lentigo maligna melanoma, acral lentiginous melanoma and nodular melanoma.

In a further embodiment, the invention provides a kit comprising an antibody construct of the invention, or produced according to the process of the invention, a vector of the invention, and/or a host cell of the invention.

It should be understood that the inventions herein are not limited to particular methodology, protocols, or reagents, as such can vary. The discussion and examples provided herein are presented for the purpose of describing particular embodiments only and are not intended to limit the scope of the present invention, which is defined solely by the claims.

All publications and patents cited throughout the text of this specification (including all patents, patent applications, scientific publications, manufacturer's specifications, instructions, etc.), whether supra or infra, are hereby incorporated by reference in their entirety. Nothing herein is to be construed as an admission that the invention is not entitled to antedate such disclosure by virtue of prior invention. To the extent the material incorporated by reference contradicts or is inconsistent with this specification, the specification will supersede any such material.

EXAMPLES

The following examples are provided for the purpose of illustrating specific embodiments or features of the present invention. These examples should not be construed as to limit the scope of this invention. The examples are included for purposes of illustration, and the present invention is limited only by the claims.

Example 1

Fully Human Monoclonal Antibodies Against CDH19

1.1 Immunization:

Fully human antibodies to Cadherin-19 (CDH19) were generated using XENOMOUSE® technology, transgenic mice engineered to express diverse repertoires of fully human IgGκ and IgGλ antibodies of the corresponding isotype. (U.S. Pat. Nos. 6,114,598; 6,162,963; 6,833,268; 7,049,426; 7,064,244, which are incorporated herein by reference in their entirety; Green et al., 1994, *Nature Genetics* 7:13-21; Mendez et al., 1997, *Nature Genetics* 15:146-156; Green and Jakobovitis, 1998, *J. Ex. Med.* 188:483-495; Kellermann and Green, *Current Opinion in Biotechnology* 13, 593-597, 2002).

Mice were immunized with multiple forms of Cadherin-19 immunogen, including: (1) full length human and cynomologous ("cyno") monkey cadherin-19, (2) secreted Cadherin-19 ecto-domain (amino acids 1-596), and (3) a truncated membrane bound form of human cadherin-19 (amino acids 1-624). Mice were immunized over a period of 8 to 10 weeks with a range of 16-18 boosts.

Sera were collected at approximately 5 and 9 weeks after the first injection and specific titers were determined by FACs staining of recombinant Cadherin-19 receptor transiently expressed on CHO-S cells. A total of 37 animals were identified with specific immune responses, these animals were pooled into 3 groups and advanced to antibody generation.

1.2 Preparation of Monoclonal Antibodies

Animals exhibiting suitable titers were identified, and lymphocytes were obtained from draining lymph nodes and, if necessary, pooled for each cohort. Lymphocytes were dissociated from lymphoid tissue by grinding in a suitable medium (for example, Dulbecco's Modified Eagle Medium (DMEM); obtainable from Invitrogen, Carlsbad, Calif.) to release the cells from the tissues, and suspended in DMEM. B cells were selected and/or expanded using standard methods, and fused with suitable fusion partner using techniques that were known in the art.

After several days of culture, the hybridoma supernatants were collected and subjected to screening assays as detailed in the examples below, including confirmation of binding to human and cynomologous monkey as well as the ability to kill cell lines in secondary antibody-drug conjugate Bioassays. Hybridoma lines that were identified to have the binding and functional properties of interest were then further selected and subjected to standard cloning and subcloning techniques. Clonal lines were expanded in vitro, and the secreted human antibodies obtained for analysis and V gene sequencing was performed.

1.3 Selection of Cadherin-19 Receptor Specific Binding Antibodies by FMAT

After 14 days of culture, hybridoma supernatants were screened for CDH19-specific monoclonal antibodies by Fluorometric Microvolume Assay Technology (FMAT) (Applied Biosystems, Foster City, Calif.). The supernatants were screened against adherent CHO cells transiently transfected with human Cadherin-19 and counter screened against CHO cells transiently transfected with the same expression plasmid that did not contain the Cadherin-19 gene.

After multiple screening campaigns, a panel of 1570 anti-Cadherin-19 binding hybridoma lines were identified and advanced to further characterization assays.

Example 2

Assessment of Fully Human Monoclonal Antibodies Against CDH19

2.1 Additional Binding Characterization by Flow Cytometry (FACs)

FACS binding assays were performed to evaluate the binding of the anti-Cadherin-19 receptor specific antibodies to endogenous Cadherin-19 receptor expressed on the CHL-1 tumor cell lines. In addition, cross-reactive binding to murine and cynomologous monkey Cadherin-19 orthologues was also evaluated by FACs using recombinant forms of the various receptors transiently expressed on 293T cells.

FACs assays were performed by incubating hybridoma supernatants with 10,000 to 25,000 cells in PBS/2% Fetal bovine serum/2 mM Calcium Chloride at 4° C. for one hour followed by two washes with PBS/2% Fetal bovine serum/2 mM Calcium Chloride. Cells were then treated with florochrome-labeled secondary antibodies at 4° C. followed by one wash. The cells were resuspended in 50 µl of PBS/2% FBS and antibody binding was analyzed using a FACSCalibur™ instrument.

2.2 Antibody Drug Conjugate Screening of Fully Human Antibodies Derived from XenoMouse® Hybridomas Cell killing through antibody drug conjugates requires the delivery of the conjugate into a cell through internalization and the catabolism of the drug-conjugate into a form that it is toxic to the cell. To identify antibodies with these properties, CDH19-positive cell lines (Colo-699 or CHL-1) were seeded at low cell densities and allowed to adhere overnight in a 384 well plate. XENOMOUSE® hybridoma samples containing fully human anti-CDH19 antibodies were then added to these cells in the presence of a high concentration of a goat anti-human Fc monovalent Fab conjugated with DM1 (DM1-Fab) at a relatively low drug-antibody ratio (DAR) (~1.3). The cells were incubated for 96 hours at 37° C. and 5% $CO_2$ in the presence of the antibody samples and the DM1-Fab. At the end of this time, the cell viability was assessed using the CellTiter-Glo® Luminescent Cell Viability reagent (Promega) according to manufacturer's recommendations.

Figure 2:
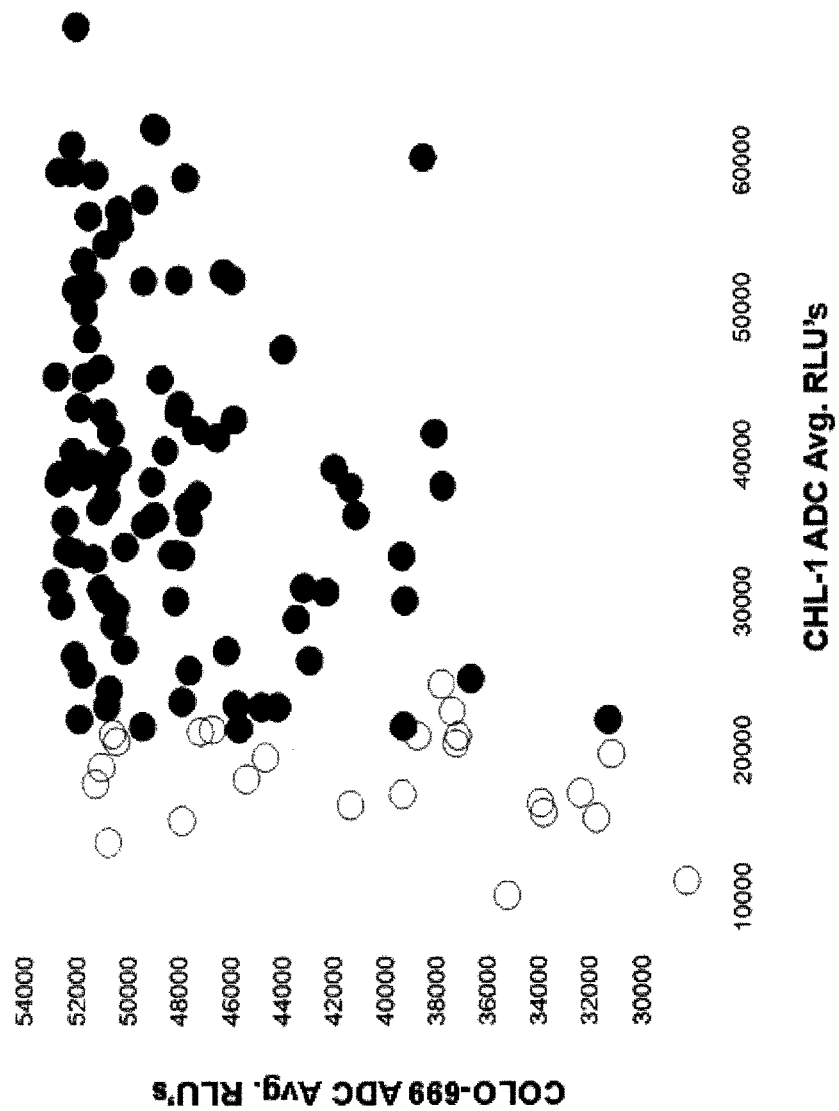
FIG. 2 depicts the average cell viability data from a CHL-1 assay plotted against the average cell viability data from the Colo-699 assay.

An example of the cell viability data with the Colo-699 cells is shown in FIG. 1 and FIG. 2. The antibodies capable of delivering the DM1-Fab to the cells and inhibiting the cell growth read out with a lower luminescent signal (RLU). The top antibodies of interest from this screen are observed in the lower left corner of FIG. 1 and are denoted as open circles. These antibodies were taken forward into a cell viability assay on CHL-1 cells. The average cell viability data from the CHL-1 assay is plotted against the average cell viability data from the Colo-699 assay (FIG. 2). The antibodies that had activity on both the Colo-699 and the CHL-1 cells are denoted as open circles on the left-hand side of the FIG. 2.

This assay was run concurrently with the FACs antibody binding assay above (2.2), and the results from these two studies were used to select the antibodies for further characterization. In total, 1570 antibodies were run through these cell based viability assays and approximately 44 antibodies were selected on the bases of in vitro cell killing and/or antibody binding for sub-cloning, V gene sequencing and expressed in recombinant form for further characterization assays as described below.

These 44 antibodies were again assayed as in Example 2 and 19 antibodies were selected that contained unique sequences. Of these 19 antibodies, 18 antibodies were analyzed and their properties characterized in Table 2 below. The data in this table was generated using FACs binding on recombinant human and cynomologous CDH-19, +/−Calcium ($Ca^{+2}$) binding data on 293/CDH-19 transfectants, binding to endogenous CDH-19 on CHL-1 and Colo699 tumor cells and competition with the antibody designated as 4A9 in the table. These experiments provided the further characterizations for the grouping of these antibodies into 5 groups or bins.

TABLE 2

Binning of Lead panel using Antibody Binding Information

| Bin ID | LMR Sequence/ Ab ID | Clone ID | Bin Characteristics |
|---|---|---|---|
| 1 | 13589 | 4A9 | High Endogenous binding, Calcium insensitive, sequence clustered, moderate cyno complete 4A9 competitor |
|  | 13591 | 4F7 |  |
| 2 | 13885 | 19B5 | High Endogenous binding, Calcium insensitive, sequence clustered, Good cyno, partial 4A9 competitor |
|  | 13880 | 25F8 |  |
|  | 13882 | 26D1 |  |
|  | 13881 | 26F12 = 27B3 |  |
|  | 13878 | 16H2 = 20D3 = 23E7 |  |
|  | 13879 | 22D1 |  |
| 3 | 13877 | 22G10 | High Endogenous binding, moderate 293 binding, Calcium insensitive, 2 sequence clusters, moderate cyno, partial 4A9 competitor, 22G10 best binder in bin. |
|  | 13874 | 17H8 = 23B6 = 28D10 |  |
|  | 13883 | 25G10 |  |
|  | 13875 | 16C1 |  |
| 4 | 13590 | 4B10 | Low Endogenous and recombinant binding, Calcium sensitive, sequence diverse group, comparable cyno, No 4A9 |
|  | 13586 | 4F3 |  |
|  | 13592 | 4A2 |  |

TABLE 2-continued

Binning of Lead panel using Antibody Binding Information

| Bin ID | LMR Sequence/ Ab ID | Clone ID | Bin Characteristics |
|---|---|---|---|
|  | 13884 | 23A10 | competition |
|  | 13588 | 2G6 |  |
| 5 | 13876 | 16A4 | Best endogenous binder, moderate recombinant binder, calcium insensitive, very weak cyno, No 4A9 competition. |

Of these 18 antibodies. 8 antibodies were selected for further analysis of their epitope binding as described below. At least one representative antibody from each bin was selected for further analysis.

Example 3

Epitope Prediction

Epitope Prediction by 4A9 Antibody Competition and by Human/Mouse Cadherin-19 Chimeras A 4A9 binding competition method was developed to identify antibodies that compete with 4A9 binding. In 96-well V-bottom plates (Sarstedt #82.1583.001), 50,000 transiently transfected 293T cells were incubated with 5 ug/ml of purified anti-CDH19 antibodies for 1 hr at 4° C. followed by one wash with PBS/2% FBS. 25 µl of 5 µg/ml Alexa647-labelled 4A9 was then added to each well and the plates incubated for 1 hour at 4° C. Cells were then washed two times and the amount of cell associated Alexa647-labelled 4A9 was quantitated by flow cytometry.

The experiments included negative controls consisting of PBS/2% FBS only. The average signal observed in these negative control experiments was adopted as the maximum possible signal for the assay. Antibodies were compared to this maximum signal and a percent inhibition was calculated for each well (% Inhibition=(1−(FL4 Geomean with the anti-CDH19 antibodies/Maximum FL4 Geomean signal)).

Domain binding was determined by flow cytometry as above on 293T cells transiently transfected with plasmids consisting of single or dual human CDH19 cadherin repeat domain replacements into the mouse Cadherin19 backbone cloned into the pTT5 expression vector immediately preceded by native human or murine CDH19 leader sequences and a Flag tag (SEQ ID NO: 968). The experiment included assaying the anti-CDH19 antibodies against mouse Cadherin19 to determine suitability for binning on these human/mouse chimeras. The data from these experiments are presented in the Table below entitled as follows:

TABLE 3

Calcium Sensitive Binding and Epitope Prediction Summary

| Clone ID | Ab ID | Bin | Ca2+ Sensitive Binding | Competes with 4A9 (13589) | Hu EC1-5 A | Hu EC1 B | Hu EC1-2 C | Hu EC2 D | Hu EC2-3 E | Hu EC3 F | Hu EC4-5 G | Hu EC5 H | Mu EC1-5 I | Predicted Epitope Region |
|---|---|---|---|---|---|---|---|---|---|---|---|---|---|---|
| 4A9 | 13589 | 1 | No | Yes | + | + | + | − | − | − | − | − | − | 44-141 |
|  | 14056 | 1 | No | Yes | + | + | + | − | − | − | − | − | − |  |
|  | 14057 | 1 | No | Yes | + | + | + | − | − | − | − | − | − |  |
| 25F8 | 13880 | 2 | No | Yes | + | + | + | − | − | − | − | − | − |  |
|  | 14094 | 2 | No | Yes | + | + | + | − | − | − | − | − | − |  |
|  | 14096 | 2 | No | Yes | + | + | + | − | − | − | − | − | − |  |
| 26D1 | 13882 | 2 | No | Yes | + | + | + | − | − | − | − | − | − |  |
|  | 14088 | 2 | No | Yes | + | + | + | − | − | − | − | − | − |  |

TABLE 3-continued

Calcium Sensitive Binding and Epitope Prediction Summary

| Clone ID | Ab ID | Bin | Ca2+ Sensitive Binding | Competes with 4A9 (13589) | Hu EC1-5 A | Hu EC1 B | Hu EC1-2 C | Hu EC2 D | Hu EC2-3 E | Hu EC3 F | Hu EC4-5 G | Hu EC5 H | Mu EC1-5 I | Predicted Epitope Region |
|---|---|---|---|---|---|---|---|---|---|---|---|---|---|---|
| 17H8 | 13874 | 3 | No | Yes | + | + | + | − | − | − | − | − | − | |
| | 14045 | 3 | No | Yes | + | + | + | − | − | − | − | − | − | |
| | 14048 | 3 | No | Yes | + | + | + | − | − | − | − | − | − | |
| 4A2 | 13592 | 4 | Yes | No | + | − | − | − | + | + | − | − | − | 250-364 |
| | 14026 | 4 | Yes | No | + | − | − | − | + | + | − | − | − | |
| 4B10 | 13590 | 4 | Yes | No | + | − | − | − | + | + | − | − | − | |
| | 14055 | 4 | Yes | No | + | − | − | − | + | + | − | − | − | |
| | 14054 | 4 | Yes | No | + | − | − | − | + | + | − | − | − | |
| 2G6 | 13588 | 4 | Yes | No | + | + | + | + | + | + | + | + | + | un-assignable |
| | 14304 | 4 | Yes | No | + | + | + | + | + | + | + | + | + | |
| | 14039 | 4 | Yes | No | + | + | + | + | + | + | + | + | + | |
| 16A4 | 13876 | 5 | No | No | + | + | + | − | − | − | − | − | − | Unassigned complex epitope |
| | 14071 | 5 | No | No | + | + | + | − | − | − | − | − | − | |
| Rat anti-FLAG | | | | | + | + | + | + | + | + | + | + | + | |

Legend Table 3
Human and/or murine chimera constructs
A = huCDH19(44-772) (see SEQ ID NO: 944)
B = huCDH19(44-141)::muCDH19(140-770) (see SEQ ID NO: 952)
C = huCDH19(44-249)::muCDH19(248-770) (see SEQ ID NO: 954)
D = muCDH19(44-139)::huCDH19(142-249)::muCDH19(248-770) (see SEQ ID NO: 956)
E = muCDH19(44-139)::huCDH19(142-364)::muCDH19(363-770) (see SEQ ID NO: 958)
F = muCDH19(44-247)::huCDH19(250-364)::muCDH19(363-770) (see SEQ ID NO: 960)
G = muCDH19(44-362)::huCDH19(365-772) (see SEQ ID NO: 962)
H = muCDH19(44-461)::huCDH19(464-772) (see SEQ ID NO: 964)
I = muCDH19(44-770) (see SEQ ID NO: 966)

Epitope Prediction by Human/Chicken Cadherin-19 Chimeras

Domain binding was determined by flow cytometry on 293T cells transiently transfected with plasmids consisting of single human CDH19 cadherin repeat domain replacements into the chicken Cadherin19 backbone cloned into the pTT5 expression vector immediately preceded by native human or chicken CDH19 leader sequences and a Flag tag. The experiment included assaying a subset of anti-CDH19 antibodies against chicken Cadherin19 to determine suitability for binning on these human/chicken chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 µl of 5 µg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-labelled Ab was quantitated by flow cytometry. The experiments included mock transfected controls. The data from these experiments are presented in the Table below, n.d.=not determined.

TABLE 4

Antibody Bin C Epitope Prediction Summary

| Clone ID | Ab. ID | Bin | Hu EC1-5 A | Ck EC1-5 J | Hu EC1 K | Hu EC2 L | Hu EC3 M | Hu EC5 O | Predicted Epitope Region |
|---|---|---|---|---|---|---|---|---|---|
| 4A9 | 13589 | 1 | + | − | + | − | − | − | 44-141 |
| 26F12 | 13881 | 2 | + | − | + | − | − | − | Bin A |
| 25F8 | 14096 | 2 | + | − | + | − | − | − | |
| 26D1 | 13882 | 2 | + | − | + | − | − | − | |
| 17H8 | 13874 | 3 | + | − | + | − | − | − | |
| 16A4 | 14071 | 5 | + | − | + | − | − | − | |
| 4A2 | 13592 | 4 | + | − | − | − | + | − | 250-364 |
| 4B10 | 13590 | 4 | + | − | − | − | + | − | Bin B |
| 2G6 | 13588 | 4 | + | − | − | − | + | − | |
| 23A10 | 14077 | 4 | + | − | − | − | + | − | |
| Rat anti-FLAG | | | + | + | + | + | + | + | control |

Positive Binding (+)
Negative Binding (−)
Legend Table 4
Human and/or chicken chimera constructs
A = huCDH19(44-772) (see SEQ ID NO: 944)
J = ckCDH19(44-776) (see SEQ ID NO: 1451)
K = huCDH19(44-141)::ckCDH19(142-776) (see SEQ ID NO: 1452)
L = ckCDH19(44-141)::huCDH19(142-249)::ckCDH19(250-776) (see SEQ ID NO: 1453)
M = ckCDH19(44-249)::huCDH19(250-364)::ckCDH19(365-776) (see SEQ ID NO: 1454)
N = ckCDH19(44-364)::huCDH19(365-463)::ckCDH19(469-776) (see SEQ ID NO: 1455)
O = ckCDH19(44-468)::huCDH19(464-772) (see SEQ ID NO: 1456)

Epitope Prediction by Macaque/Dog or Rat/Macaque Cadherin-19 Chimeras

Domain binding was determined by flow cytometry on 293T cells transiently transfected with plasmids consisting of rhesus macaque CDH19 cadherin repeat domain 1 or segments domain 1 (designated EC1a, EC1b, EC1c) replacements into the dog Cadherin19 backbone, or rat CDH19 cadherin repeat domain 2 replacement into the rhesus Cadherin19 backbone cloned into the pTT5 expression vector immediately preceded by native rhesus or canine CDH19 leader sequences and a Flag tag. The experiment included assaying a subset of anti-CDH19 antibodies against dog, rat and macaque Cadherin19 to determine suitability for binning on these macaque/dog and rat/rhesus chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 µl of 5 µg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-labelled Ab was quantitated by flow cytometry. The experiments included mock transfected controls. The data from these experiments are presented in the Table below, n.d.=not determined.

rat and mouse Cadherin19 to determine suitability for binning on these rat/mouse and human/mouse chimeras.

The following binding assay was completed in presence of 2 mM CaCl2. In 96-well V-bottom plates (Costar 3897), 50,000 transiently transfected 293T cells were incubated with 5 ug/ml of purified anti-CDH19 antibodies for 1 hr at 4° C. followed by two washes with PBS/2% FBS. 50 µl of 5 µg/ml Alexa647-labelled anti-human IgG secondary antibody (Jackson Immuno 109-605-098) and 2 ug/ml 7AAD (Sigma A9400) was then added to each well and the plates incubated for 15 minutes at 4° C. Cells were then washed one time and the amount of cell associated Alexa647-labelled Ab was quantitated by flow cytometry. The experiments included mock transfected controls. The data from these experiments are presented in the Table below, n.d.=not determined.

TABLE 5

Antibody BinA Epitope prediction Summary

| Clone ID | Ab. ID | Bin | Rh EC1-5 P | Ca EC1-5 Q | rh EC1 R | rh EC1a S | rh EC1b T | ra EC2 V | Ra EC1-5 W | Predicted Epitope Region |
|---|---|---|---|---|---|---|---|---|---|---|
| 4A9 | 13589 | 1 | + | − | + | − | − | − | − | 44-141 Bin A.1 |
| 26F12 | 13881 | 2 | + | − | + | + | + | − | − | 44-141 |
| 25F8 | 14096 | 2 | + | − | + | + | + | − | − | Bin A.2 (44-114) |
| 26D1 | 13882 | 2 | + | − | + | + | + | − | − | |
| 17H8 | 13874 | 3 | + | − | + | + | − | − | − | 44-141 |
| 16A4 | 14071 | 5 | + | − | + | + | − | n.d. | + | Bin A.3 (44-65) |
| 4A2 | 13592 | 4 | + | − | n.d. | n.d. | n.d. | n.d. | + | 250-364 |
| 4B10 | 13590 | 4 | + | + | n.d. | n.d. | n.d. | n.d. | + | Bin B |
| 2G6 | 13588 | 4 | + | + | n.d. | n.d. | n.d. | n.d. | + | |
| 23A10 | 14077 | 4 | + | + | n.d. | n.d. | n.d. | n.d. | + | |
| Rat anti-FLAG | | | + | + | + | + | + | + | + | |

Positive Binding (+)
Negative Binding (−)
Not Determined (n.d.)
Legend Table 5
Rhesus macaque, dog, and/or rat chimera constructs
P = rhCDH19(44-772) (see SEQ ID NO: 1457)
Q = caCDH19(44-770) (see SEQ ID NO: 1458)
R = rhCDH19(44-141)::caCDH19(141-770) (see SEQ ID NO: 1459)
S = rhCDH19(44-65)::caCDH19(65-770) (see SEQ ID NO: 1460)
T = caCDH19(44-87)::rhCDH19(89-114)::caCDH19(115-770) (see SEQ ID NO: 1461)
U = caCDH19(44-120)::rhCDH19(122-137)::caCDH19(137-770) (see SEQ ID NO: 1462)
V = rhCDH19(44-141)::raCDH19(140-247)::rhCDH19(250-772) (see SEQ ID NO: 1463)
W = raCDH19(44-770) (see SEQ ID NO: 1464)

The data summarized in table 5 allowed for segregating the binder of Bin A 44-141 into the following subgroups:
Bin A.1 44-141
Bin A.2 44-141 (44-114)
Bin A.3 44-141 (44-65)
Epitope Prediction by rat/mouse or human/mouse Cadherin-19 Chimeras Domain binding was determined by flow cytometry on 293T cells transiently transfected with plasmids consisting of rat CDH19 cadherin repeat domain 3 substitutions (designated EC3a, EC3b) or human CDH19 cadherin repeat domain 3 substitution (designated EC3c) into the mouse Cadherin19 backbone cloned into the pTT5 expression vector immediately preceded by native mouse CDH19 leader sequence and a Flag tag. The experiment included assaying a subset of anti-CDH19 antibodies against human,

TABLE 6

Antibody Bin B Epitope Prediction Summary

| Clone ID | Ab. ID | Bin | Hu EC1-5 A | Mo EC1-5 I | Ra EC1-5 W | Ra EC3c X | Ra EC3b Y | Hu EC3a Z | Predicted Epitope Region |
|---|---|---|---|---|---|---|---|---|---|
| 4A9 | 13589 | 1 | + | − | − | n.d. | n.d. | n.d. | 44-141 |
| 26F12 | 13881 | 2 | + | − | − | n.d. | n.d. | n.d. | Bin A |
| 25F8 | 14096 | 2 | + | − | − | n.d. | n.d. | n.d. | |
| 26D1 | 13882 | 2 | + | − | − | n.d. | n.d. | n.d. | |
| 17H8 | 13874 | 3 | + | − | − | n.d. | n.d. | n.d. | |
| 16A4 | 14071 | 5 | + | − | + | n.d. | n.d. | n.d. | |
| 4A2 | 13592 | 4 | + | − | + | + | − | − | 250-364 |
| 4B10 | 13590 | 4 | + | − | + | + | − | − | (324-327) Bin B.2 |
| 2G6 | 13588 | 4 | + | + | | + | + | + | 250-364 |

TABLE 6-continued

Antibody Bin B Epitope Prediction Summary

| Clone ID | Ab. ID | Bin | Hu EC1-5 A | Mo EC1-5 I | Ra EC1-5 W | Ra EC3c X | Ra EC3b Y | Hu EC3a Z | Predicted Epitope Region |
|---|---|---|---|---|---|---|---|---|---|
| 23A10 | 14077 | 4 | + | + | + | n.d. | n.d. | n.d. | Bin B.1 |
| Rat anti-FLAG | | | + | + | + | + | + | + | control |

Positive Binding (+)
Negative Binding (−)
Not Determined (n.d.)
Legend Table 6
Rat/mouse or human/mouse chimera constructs
A = huCDH19(44-772) (see SEQ ID NO: 944)
I = muCDH19(44-770) (see SEQ ID NO: 966)
W = raCDH19(44-770) (see SEQ ID NO: 1464)
X = muCDH19(44-323)::raCDH19(324-327)::muCDH19(328-770) (see SEQ ID NO: 1465)
Y = muCDH19(44-770)::raCDH19(290, 299, 308) (see SEQ ID NO: 1466)
Z = muCDH19(44-770)::huCDH19(271) (see SEQ ID NO: 1467)

The data summarized in table 6 allowed for segregating the binder of Bin B 250-364 into the following subgroups:
Bin B.1 250-364
Bin B.2 250-364 (324-327)) by rodent numeration as referenced in table 6, corresponding to residues (326-329) within human and macaque CDH19.

Example 4

Hotspot/Covariant Mutants

A total of 18 antibodies were analyzed for potential hotspots and covariance violations. The designed variants (shown below) outline amino acid substitutions capable of reducing and/or avoiding isomerization, deamidation, oxidation, covariance violations, and the like. The 80 engineered variants together with the 15 parental antibodies, thus totaling 95 sequences, were taken forward to the cloning, expression, and purification processes. Site-directed mutagenesis was performed on the engineered variants in a 96-well format. The parental antibodies and engineered variants were expressed by high throughput transient transfection in HEK 293-6E cells, purified using a modified AKTA auto-sampler and assayed for activity and biophysical characteristics. The 3 parental antibodies that had either free (unpaired) Cys or N-glycosylation site were not taken forward in this process. Those were replaced with the engineered version of the parental antibodies. The designed variants outline amino acid substitutions capable of reducing and/or avoiding isomerization, deamidation, oxidation, covariance violations, immunogenicity and the like. It will be appreciated that these variant sequences are examples of engineered antibodies within the meaning of the present application but single point and/or multiple point mutations can be combined in any combinatorial manner in order to arrive at a final desired antigen binding molecule or antibody.

Example 5

CDH19 mRNA Expression Pattern

Figure 3:
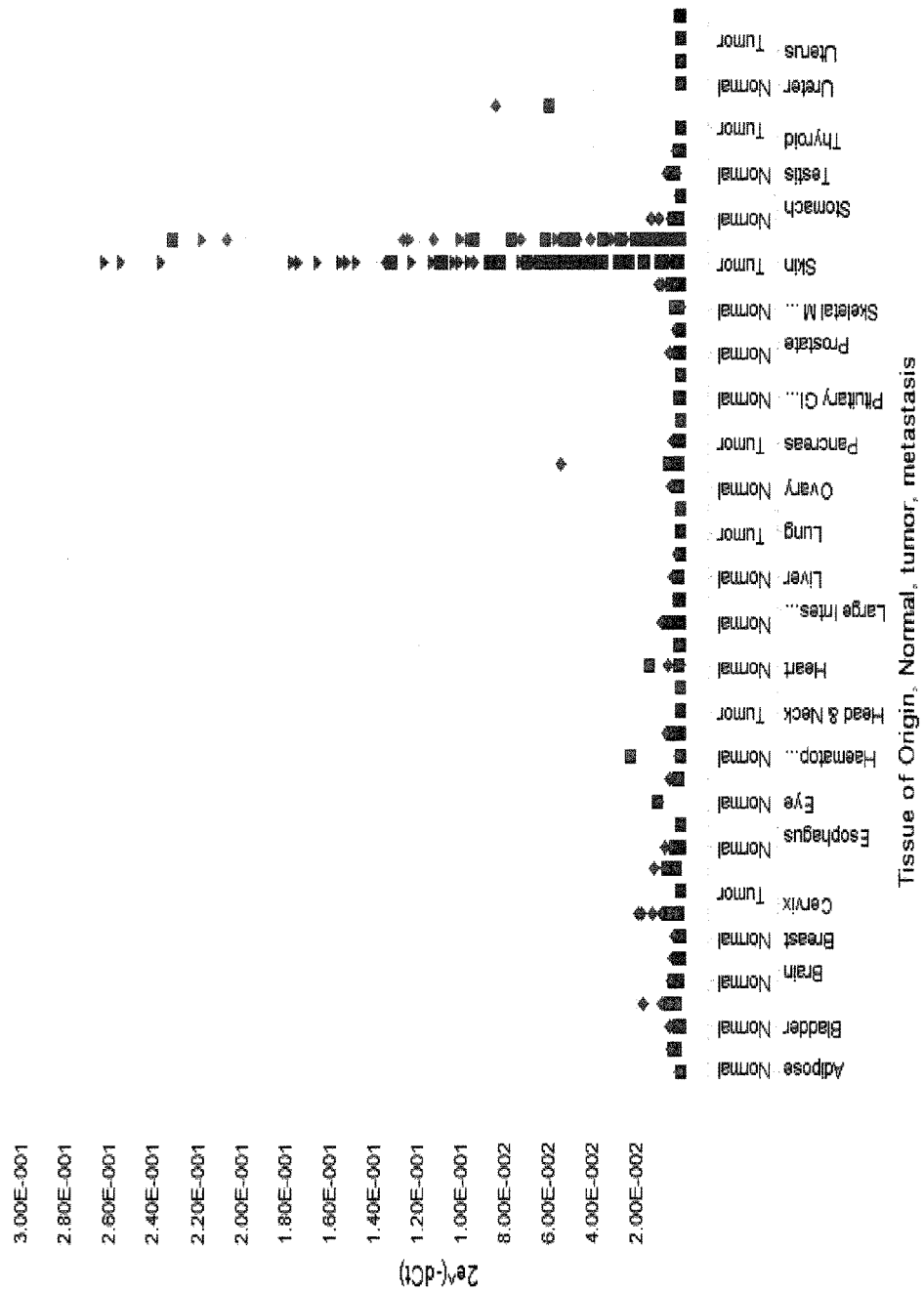
FIG. 3 shows the relative expression of CDH19 mRNA in metastatic and primary melanoma samples.

RNA was extracted from individual patient tissues representing tumor (>70% tumor content by cell count) or normal (0% tumor content by cell count). Individual tissues were homogenized using TisssueLyzer (Qiagen, Valencia, Calif.) and total RNA extracted and purified by the mirVana total RNA extraction kit (Life Technologies, Foster City, Calif.). RNA quality and quantity checked by NanoDrop (NanoDrop, Wilmington, Del.) spectrophotometer readings and Bioanalyzer RNA profiling (Agilient Technologies, Santa Clara, Calif.). RNA was DNAse treated with DNA-free kit (Life Technologies, Foster City, Calif.) and reverse transcribed according to manufacturer's specifications using random hexamers in the High Capacity cDNA Reverse Transcription Kit (Life Technologies, Foster City, Calif.). Quantitative Real Time Polymerase Chain Reaction (qRT-PCR) was performed on cDNA using primers to CDH19, probeset Hs00253534_m1, (Life Technologies, Foster City, Calif.) or the housekeeping gene human ACTB (primers CCT GGC ACC CAG CAC AA; GCC GAT CCA CAC GGA GTA CT; probe ATC AAG ATC ATT GCT CCT CCT GAG CG). 10 µL qRT-PCR reaction components; 1.0 ng/µL cDNA, 2× Universal PCR Master Mix (Life Technologies, Foster City, Calif.), gene expression assay (ACTB; 75 nM primers, 150 nM probe. EPOR; 300 nM primers, 250 nM probe) Following the qRT-PCR amplification program: (1) activation at 50° C. for 2 min; (2) denaturation at 95° C. for 10 min; (3) amplification 40 cycles at 95° C. for 15 s and 60° C. for 1 min with fluorescence capture at each step (ABI PRISM 7900HT Sequence Detection Systems, Applied Biosystems). Threshold cycle values ($C_T$) were determined, using Sequence Detector software version 2.3 (Applied Biosystems) and transformed to $2^{-\Delta CT}$ for relative expression of CDH19 specific transcript to ACTB. The results are shown in FIG. 3. Of 54 unique metastatic and primary melanoma samples, the majority can be seen to overexpress CDH19 mRNA relative to the expression in samples from normal tissue.

Example 6

CDH19 Protein Expression

Figure 4:
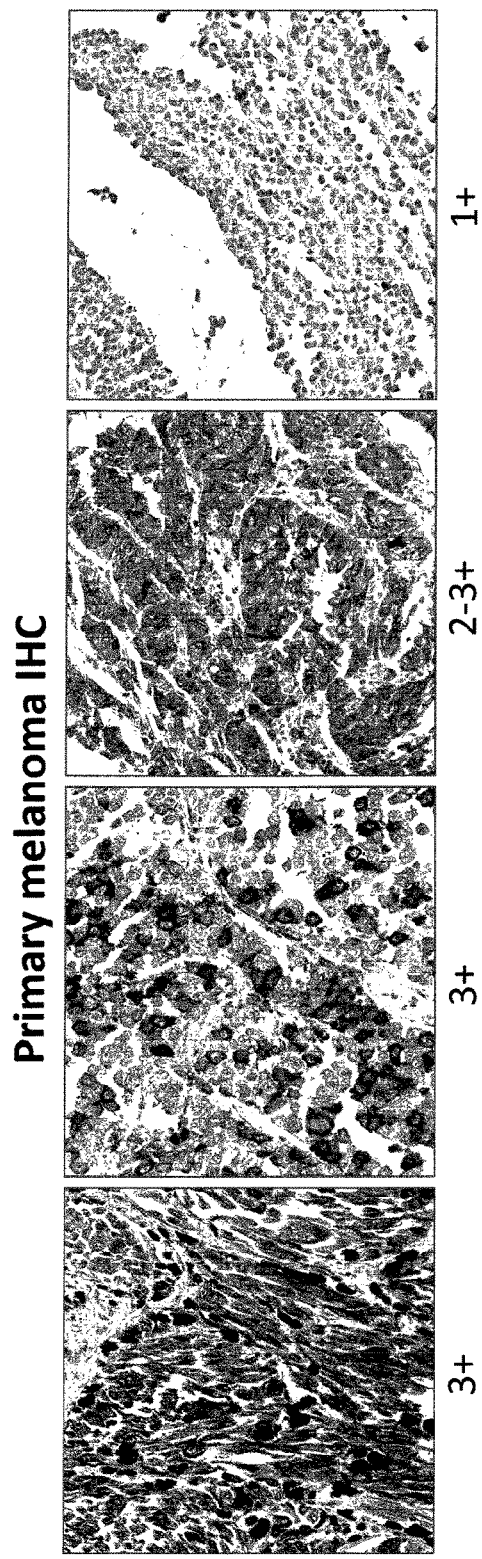
FIG. 4 shows the expression of CDH19 protein in human tumor samples by IHC.

Expression of CDH19 protein was analyzed in human tumor samples by IHC and the results are shown in FIG. 4. Samples were fixed in 10% neutral buffered formalin for 24 hours, dehydrated and paraffin embedded. 4 µm sections were cut. Sections were deparaffinized first and then heated in DIVA Decloaker solution (Biocare) for 40 minutes for antigen retrieval. Remaining IHC steps were performed at room temperature in a DAKO Autostainer. Sections were incubated for 10 minutes with Peroxidazed 1 (Biocare) to block endogenous peroxidase, followed by incubation for 10 minutes with background sniper (Biocare) to reduce non-specific background. Section were incubated for 60 minutes with CDH19 antibody (Novo Biologicals, Catalog #H00028513-B01P) at 5 µg/ml, then incubated for 30 minutes with Envision+HRP anti-mouse polymer (DAKO), followed by DAB+(DAKO) for 5 minutes. Sections were counterstained with hematoxylin (DAKO) approximately for 1 minute. CDH19 expression could be detected in 62% of tumors examined (staining intensity ≥1+ in 101 of 162 samples). 51% of the tumor samples demonstrated medium to high expression (staining intensity of 2+ to 3+ in 83 of 162 samples). CDH19 showed dense and distinct membrane staining in many samples, although in some tumors heterogeneity was noted.

Example 7

Selection of Model Cell Lines

Figure 5:
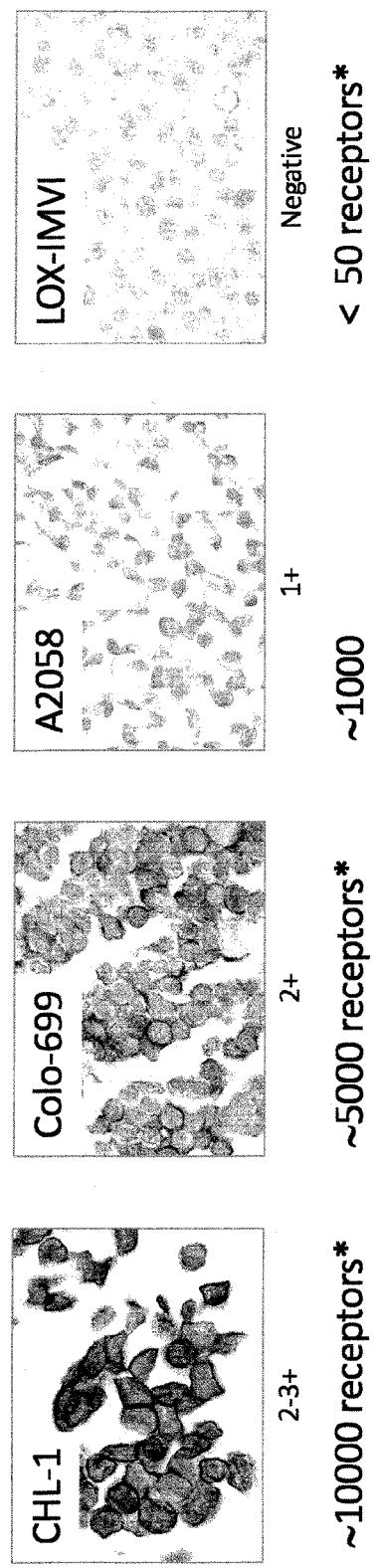
FIG. 5 shows the results of the analysis of tumor cell lines by flow cytometry and IHC to identify model systems with CDH19 expression similar to human tumors based on the number of CDH19 receptors present on the cell surface.

Tumor cell lines were analyzed by flow cytometry and IHC to identify model systems with CDH19 expression similar to human tumors. Human anti-huCDH19 IgG4 antibody 4A2 was purified directly from hybridoma conditioned media. For flow cytometry, $2\times10^5$ cells were incubated with 200 nM of the CDH19 4A2 antibody that was conjugated to PE at a 1:1 ratio. The incubation and subsequent wash steps were performed in the presence of 1.2 mM calcium. A tube of QuantiBRITE PE lyophilized beads with four levels of PE (BD, cat#340495) was simultaneously prepared according to the manufacturer's instructions. The beads were analyzed by flow cytometry to generate a standard curve. The PE median values obtained from the melanoma lines after FACS analysis were then calibrated against the standard curve to calculate the antibodies bound per cell (ABC), which provides an estimate of the number of receptors on each cell. IHC was performed as described in Example 6 and the results are provided in FIG. 5. The melanoma cell line CHL-1 expresses about 10,000 CDH19 molecules on the cell surface, while Colo699 cells express about 5,000 receptors. Both cell lines represent tumors with medium to high expression levels based on IHC. Expression in A2058 is very low, while LOX cells do not express any detectable CDH19 protein.

Example 8

Bispecific Binding and Interspecies Cross-reactivity

For confirmation of binding to human CDH19 and to human and macaque CD3, bispecific antibodies were tested by flow cytometry using indicated cell lines. L1.2 transfected with human CDH19, the human melanoma cell lines CHL-1 and A2058 expressing native human CDH19, CD3-expressing human T cell leukemia cell line HPB-ALL (DSMZ, Braunschweig, ACC483) and the CD3-expressing macaque T cell line 4119LnPx (Knappe A, et al., Blood, 2000, 95, 3256-3261) were used as antigen positive cell lines. Moreover, untransfected L1.2 cells were used as negative control.

For flow cytometry 200,000 cells of the respective cell lines were incubated for 30 min on ice with 50 µl of purified bispecific antibody at a concentration of 5 µg/ml. The cells were washed twice in PBS/2% FCS and binding of the constructs was detected with a murine PentaHis antibody (Qiagen; diluted 1:20 in 50 µl PBS/2% FCS). After washing, bound PentaHis antibodies were detected with an Fc gamma-specific antibody (Dianova) conjugated to phycoerythrin, diluted 1:100 in PBS/2% FCS. Samples were measured by flow cytometry on a FACSCanto II instrument and analyzed by FACSDiva software (both from Becton Dickinson).

Figure 6:
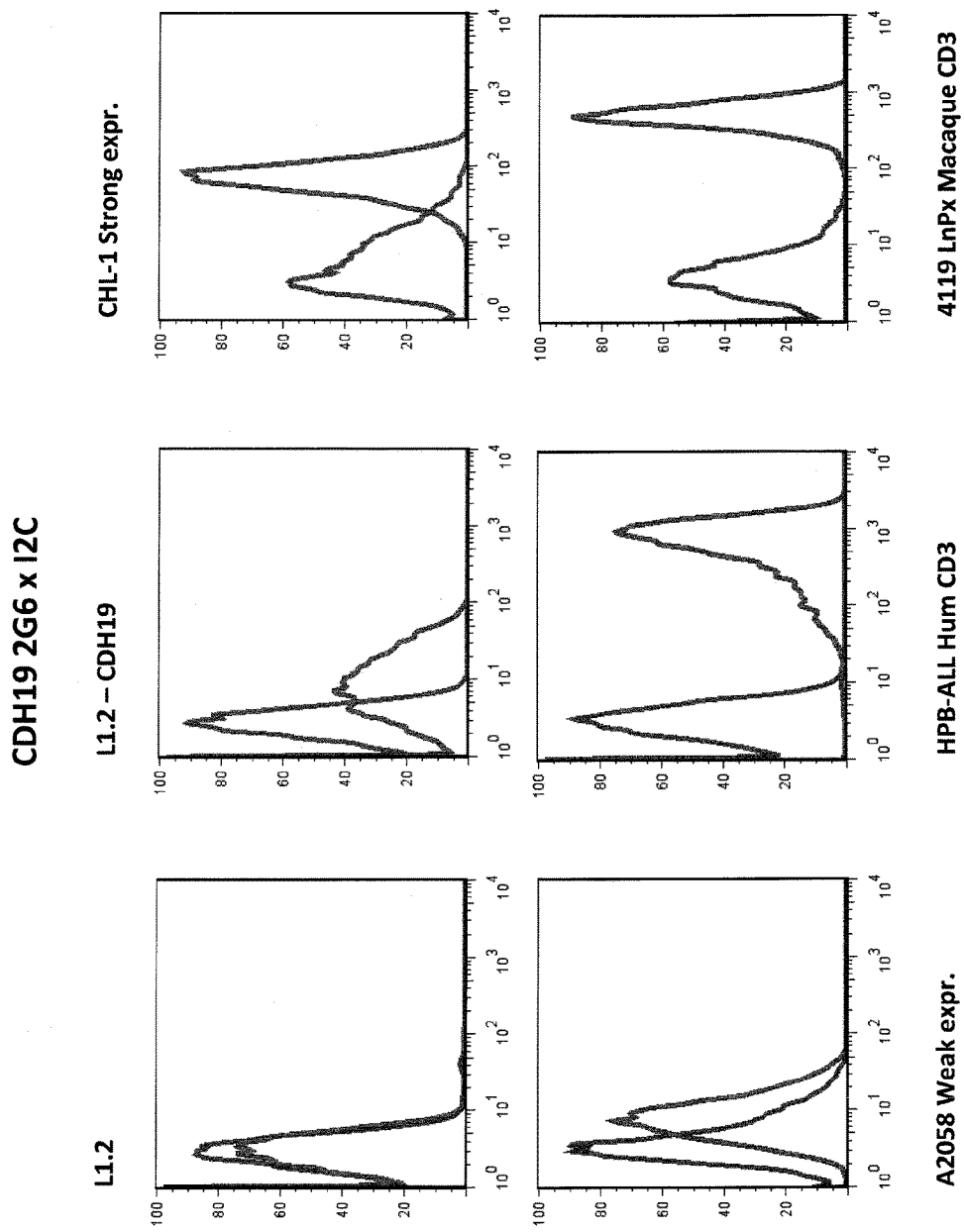
FIG. 6 FACS analysis of CDH19/CD3 bispecific antibodies on indicated cell lines:
1) untransfected L1.2. 2) L1.2 cells stably transfected with human CDH19, 3) melanoma cell line CHL-1, 4) melanoma cell line A2058, 5) human CD3 positive human T cell line HBP-ALL, 6) macaque T cell line 4119 LnPx. Negative controls [1) to 6)]: detection antibodies without prior CDH19/CD3 bispecific antibody.
Figure 6:
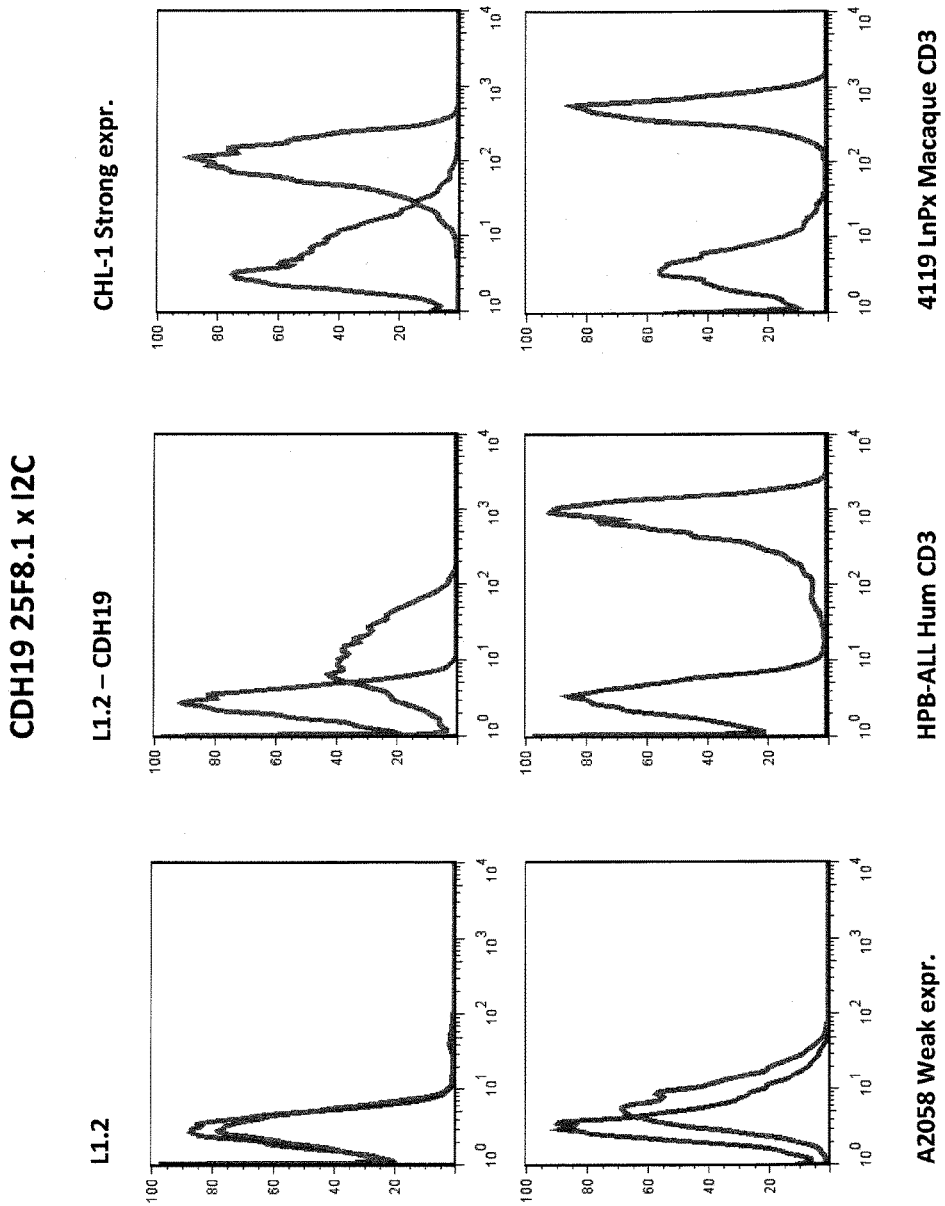
Figure 6:
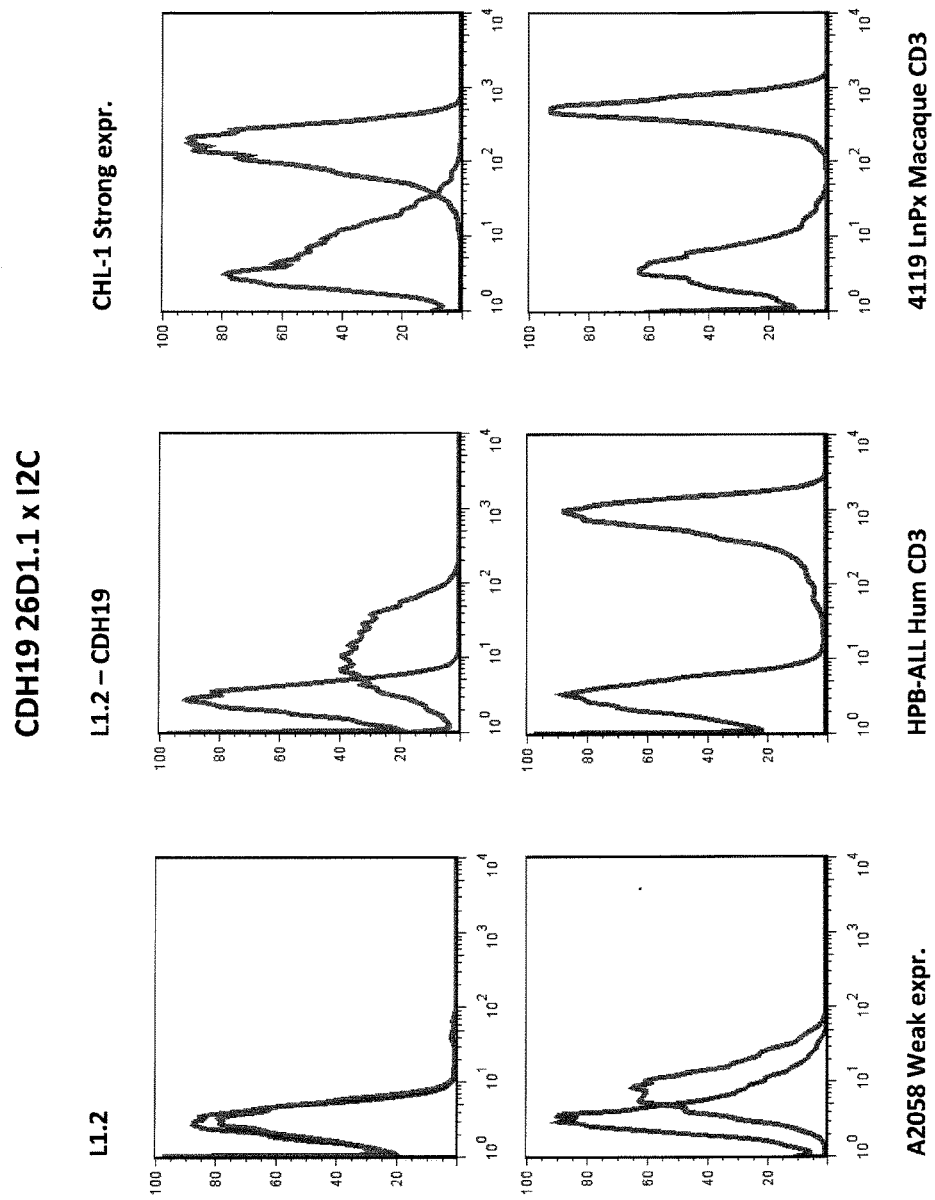
Figure 6:
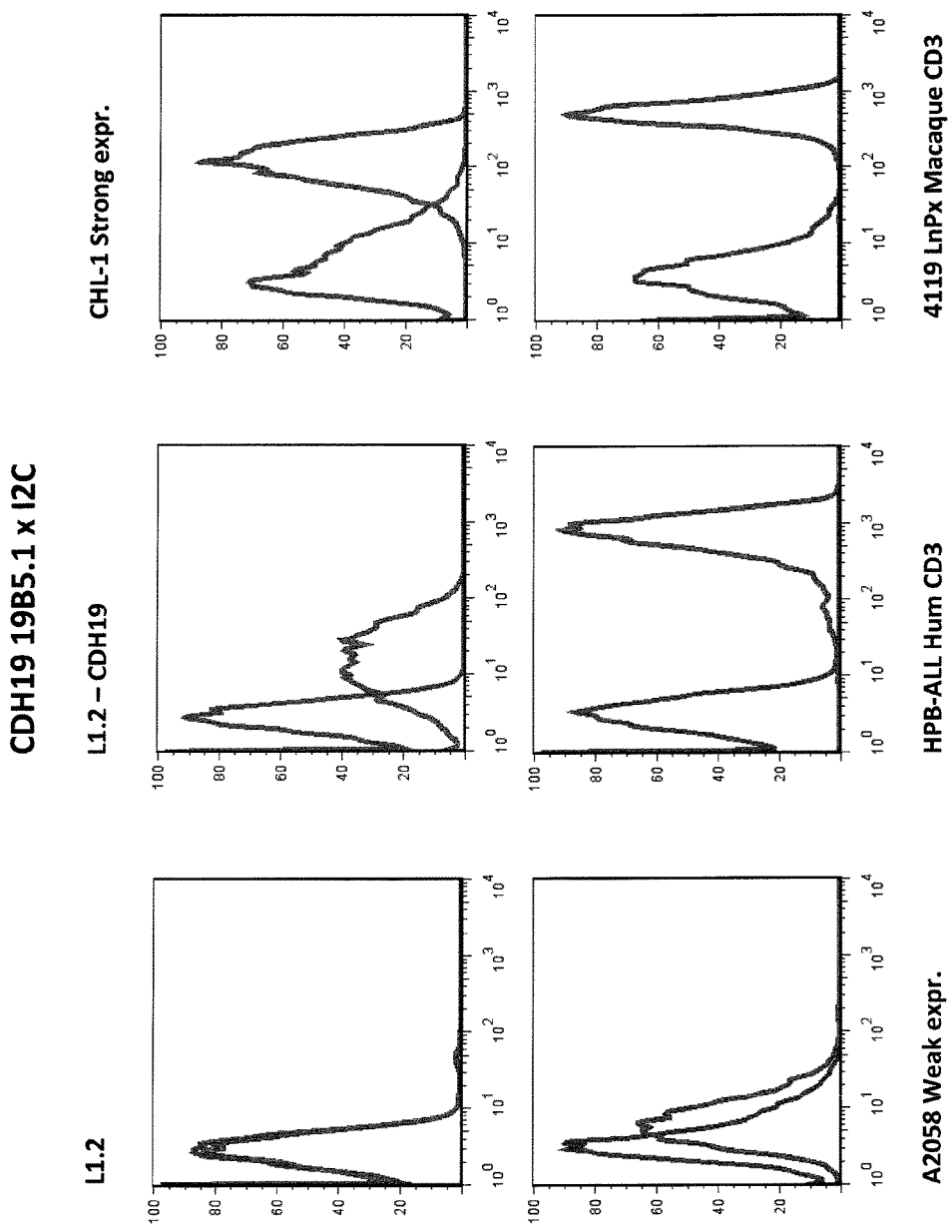
Figure 6:
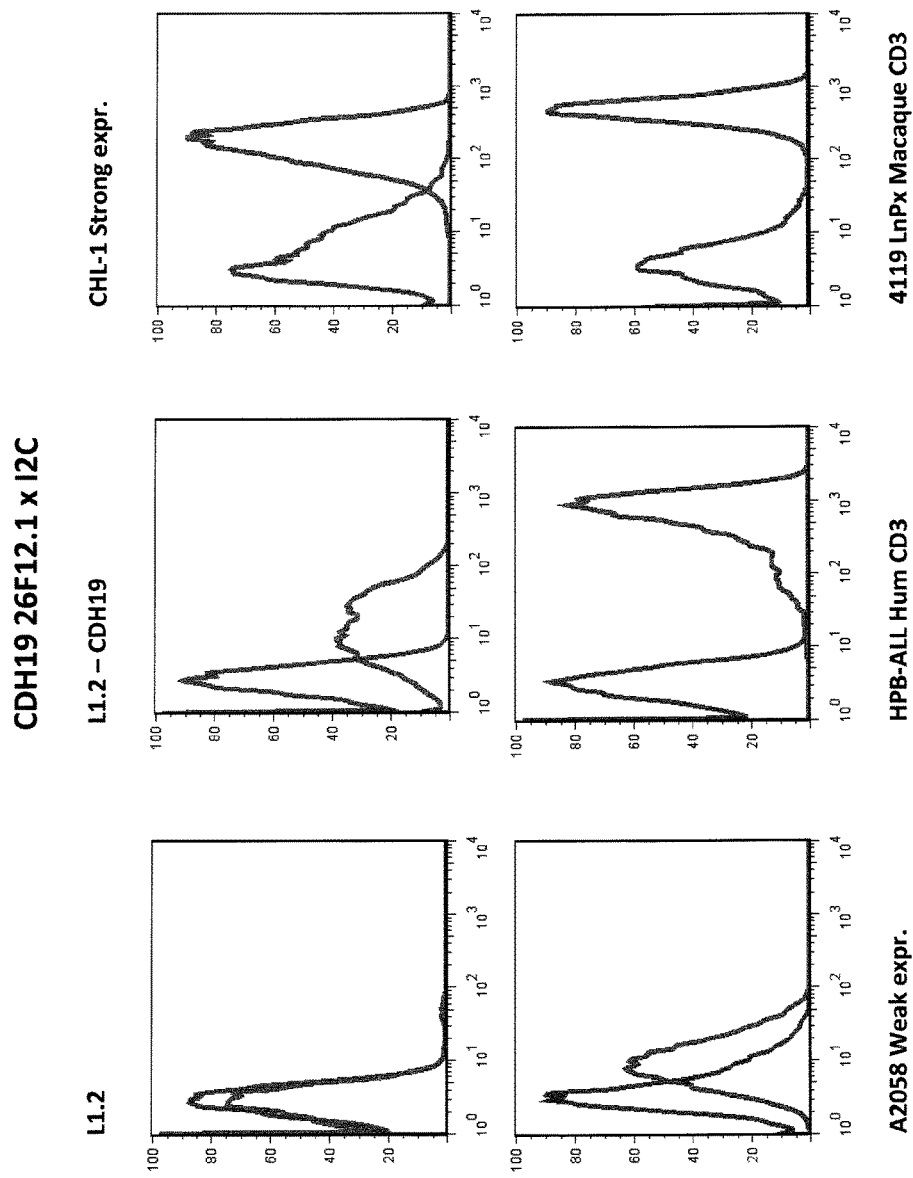
Figure 6:
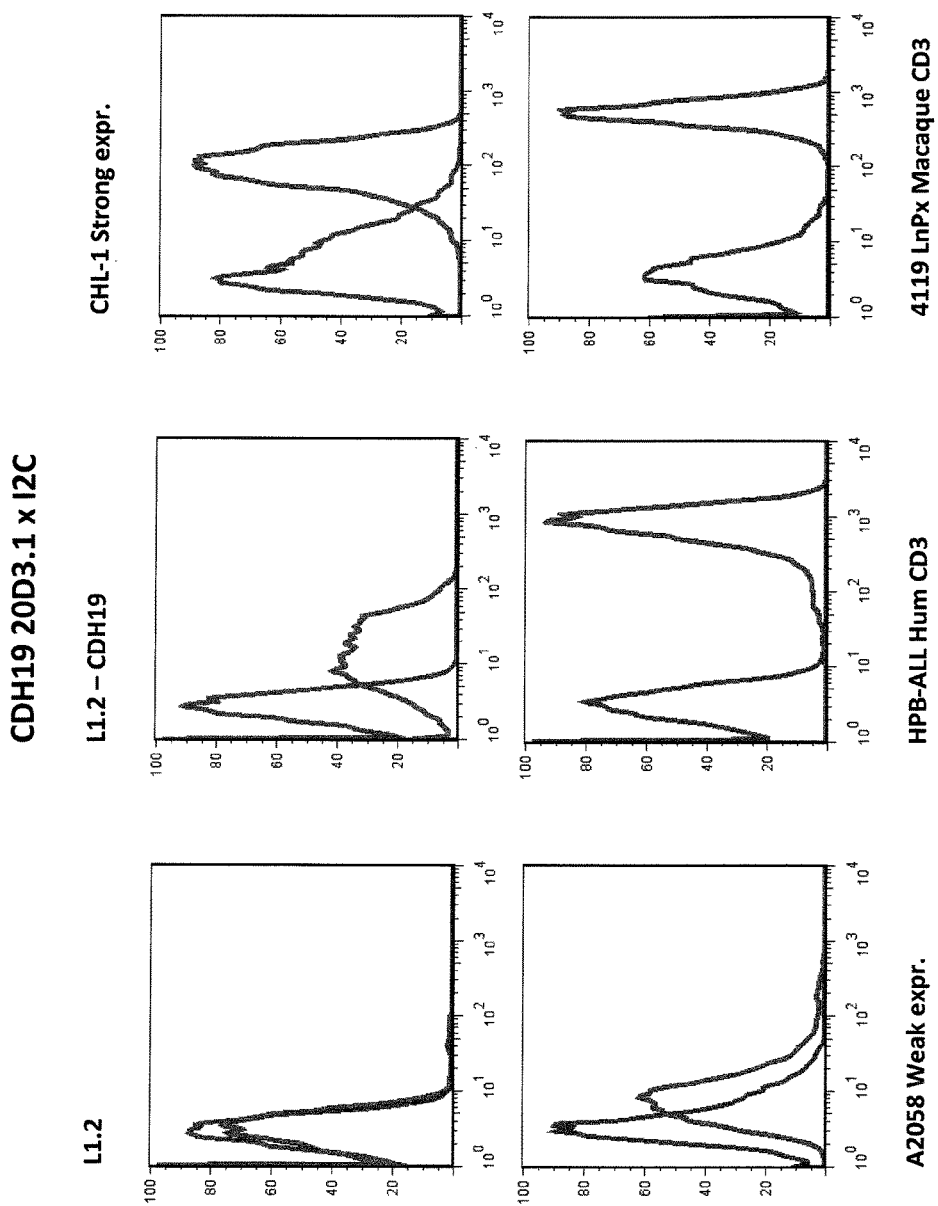
Figure 6:
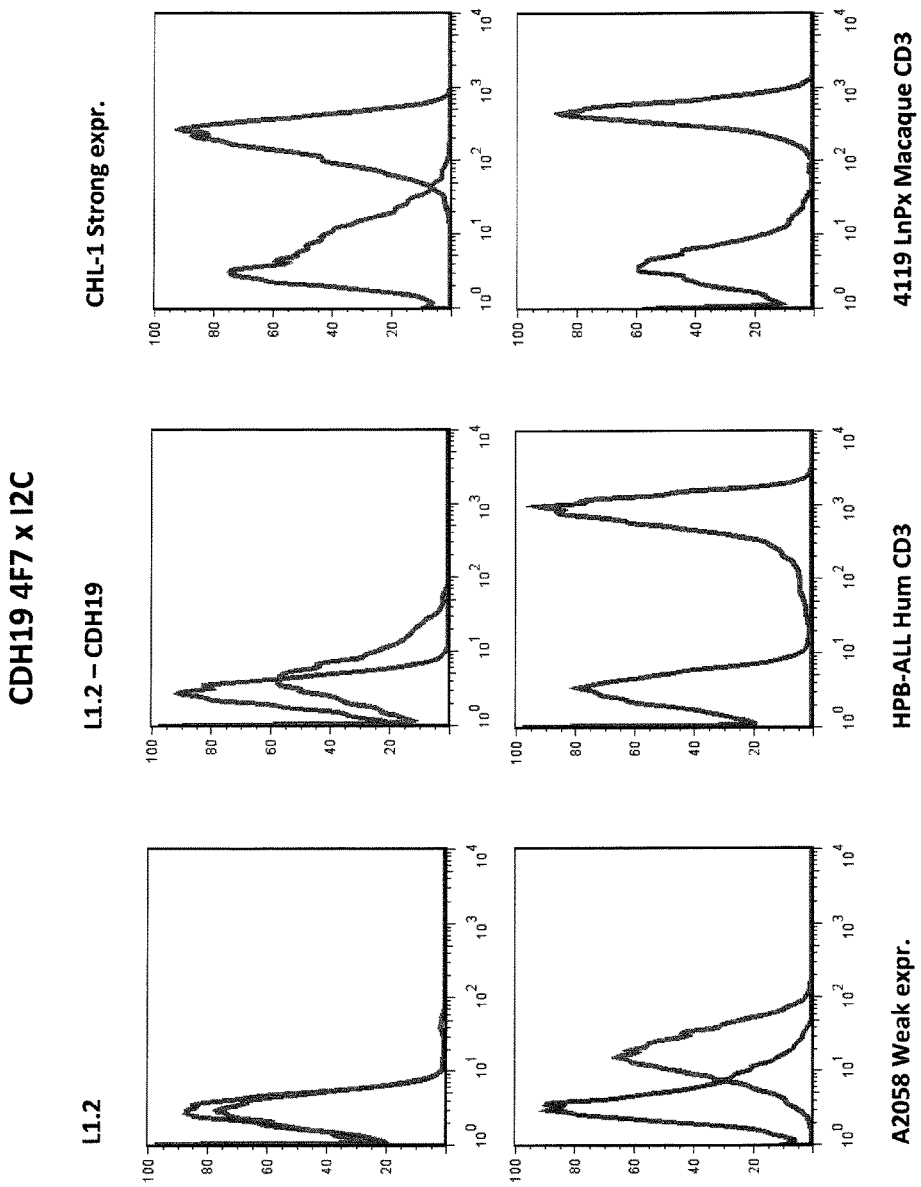
Figure 6:
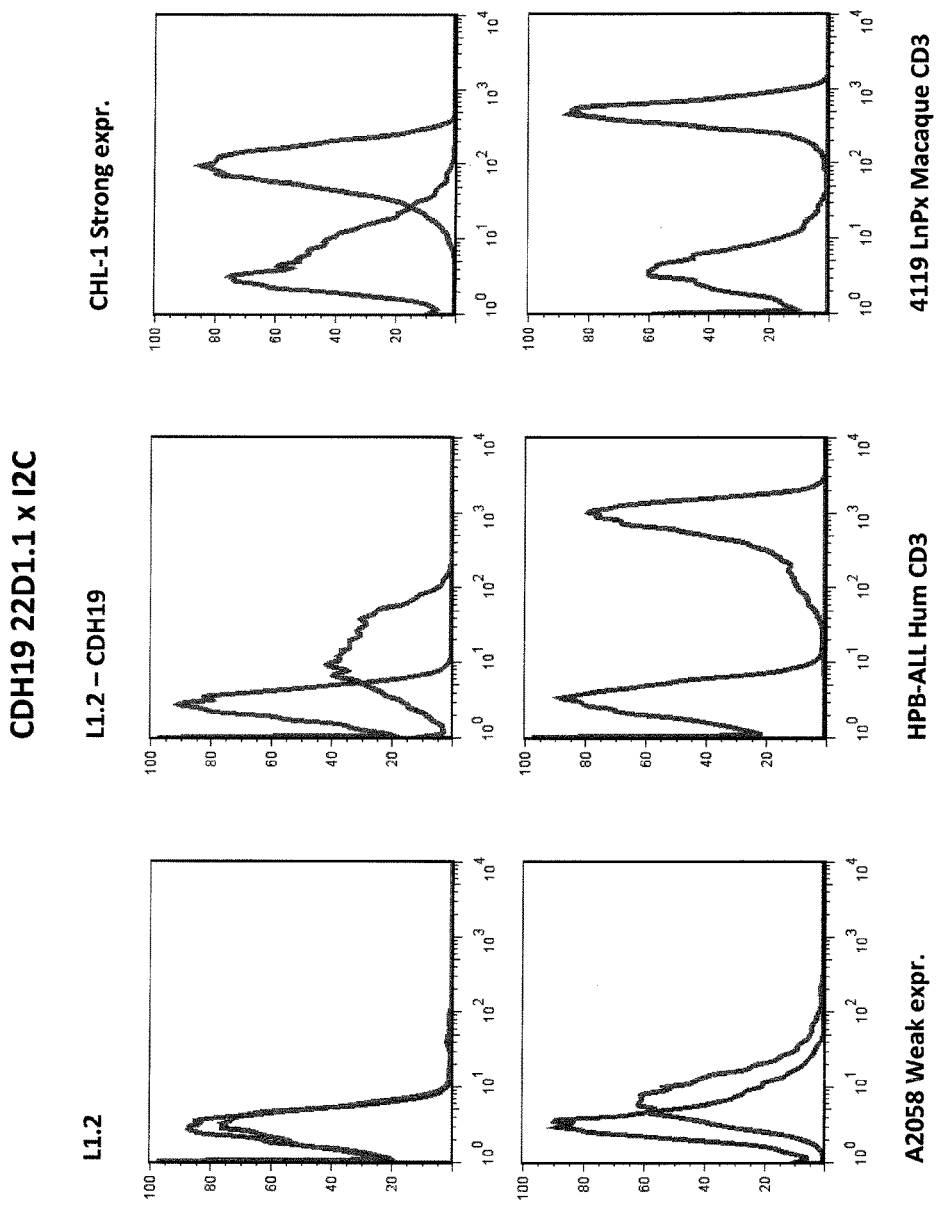
Figure 6:
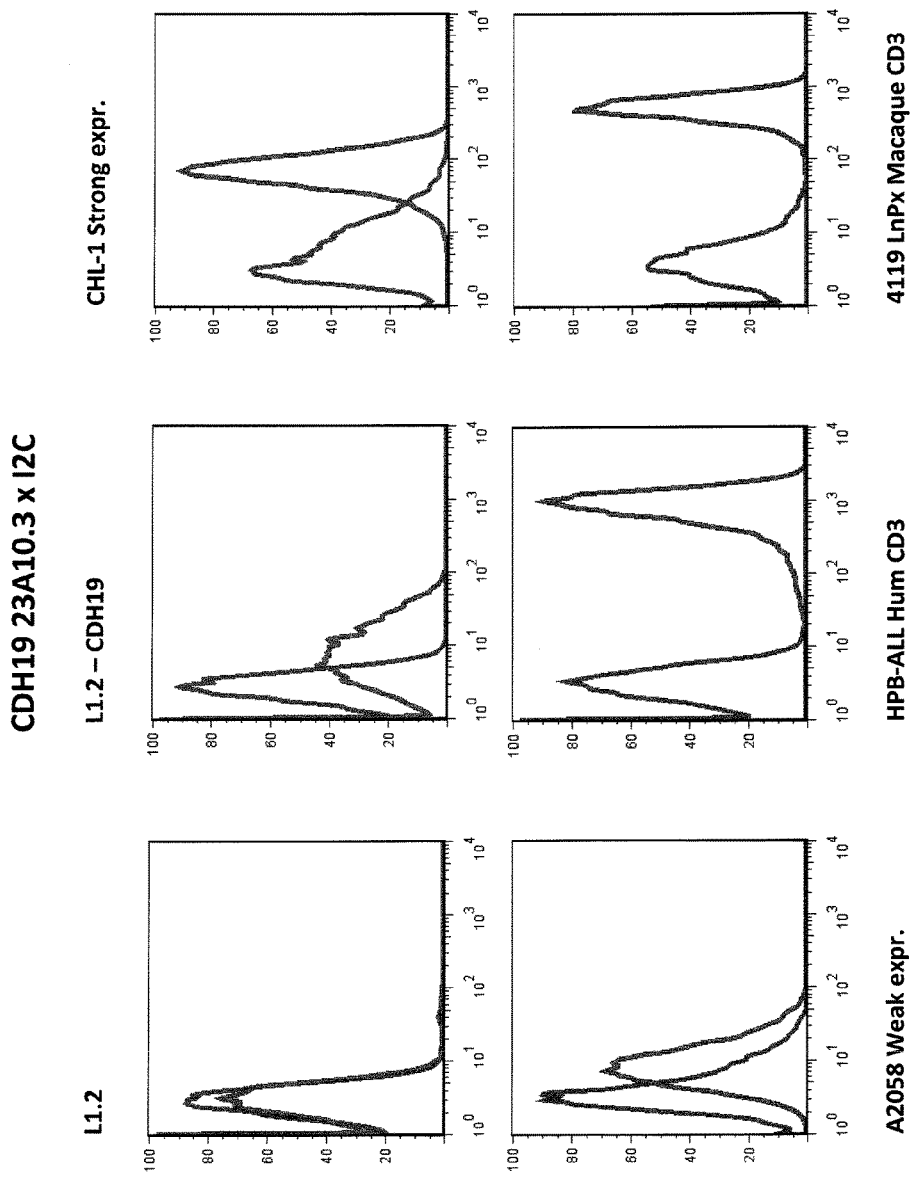
Figure 6:
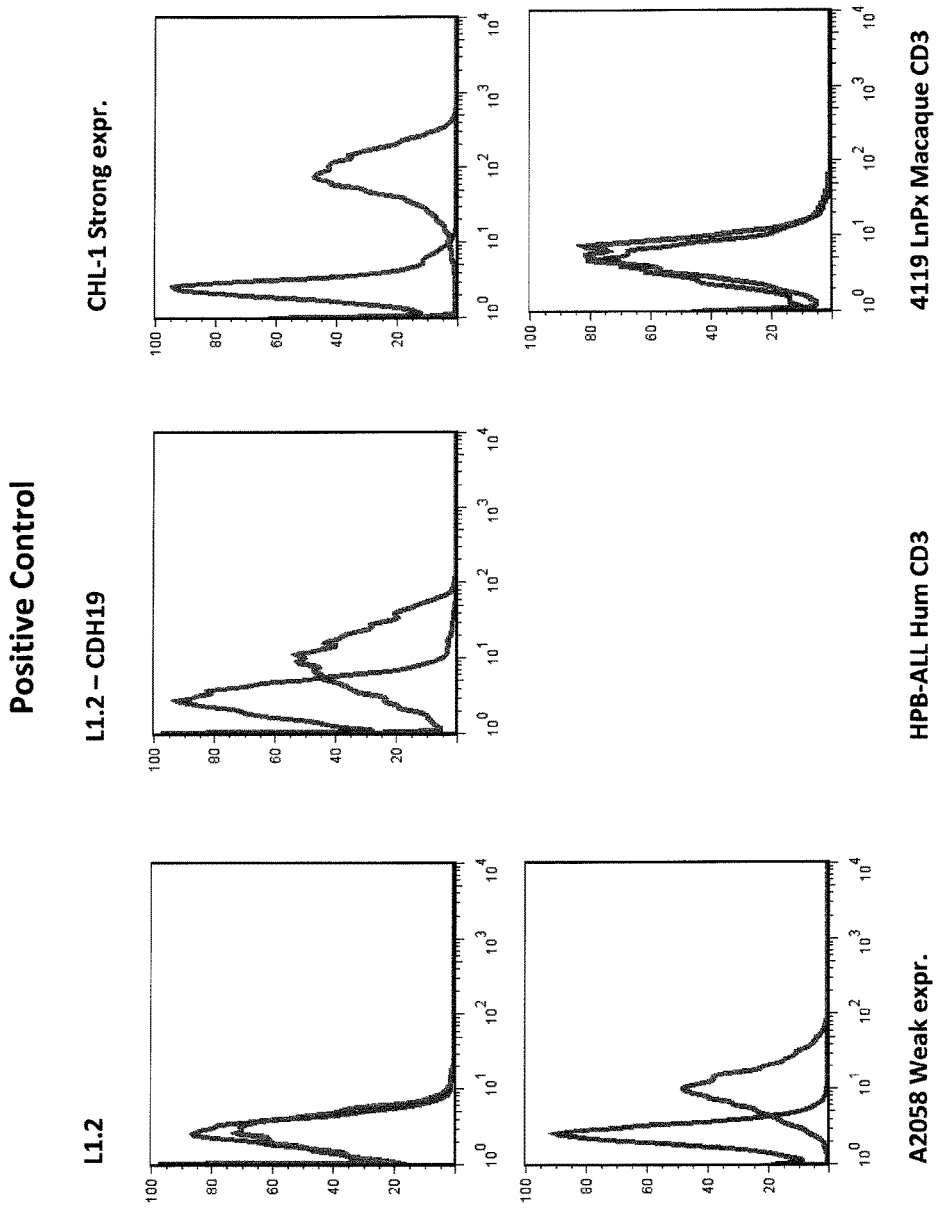

The CDH19/CD3 bispecific antibodies stained L1.2 cells transfected with human CDH19, the human CDH19-expressing melanoma cell lines CHL-1 and A2058 as well as human and macaque T cells. Moreover, there was no staining of untransfected L1.2 cells (see FIG. 6).

Example 9

Cytotoxic Activity
FACS-based Cytotoxicity Assay with Unstimulated Human PBMC
Isolation of Effector Cells Human peripheral blood mononuclear cells (PBMC) were prepared by Ficoll density gradient centrifugation from enriched lymphocyte preparations (e.g. buffy coats), a side product of blood banks collecting blood for transfusions. Buffy coats were supplied by a local blood bank and PBMC were prepared on the same day of blood collection. After Ficoll density centrifugation and extensive washes with Dulbecco's PBS (Gibco), remaining erythrocytes were removed from PBMC via incubation with erythrocyte lysis buffer (155 mM $NH_4Cl$, 10 mM $KHCO_3$, 100 µM EDTA). Platelets were removed via the supernatant upon centrifugation of PBMC at 100×g. Remaining lymphocytes mainly encompass B and T lymphocytes, NK cells and monocytes. PBMC were kept in culture at 37° C./5% $CO_2$ in RPMI medium (Gibco) with 10% FCS (Gibco).
Depletion of CD14$^+$ and CD56$^+$ Cells For depletion of CD14$^+$ cells, human CD14 MicroBeads (Milteny Biotec, MACS, #130-050-201) were used, for depletion of NK cells human CD56 MicroBeads (MACS, #130-050-401). PBMC were counted and centrifuged for 10 min at room temperature with 300×g. The supernatant was discarded and the cell pellet resuspended in MACS isolation buffer [80 µL/$10^7$ cells; PBS (Invitrogen, #20012-043), 0.5% (v/v) FBS (Gibco, #10270-106), 2 mM EDTA (Sigma-Aldrich, #E-6511)]. CD14 MicroBeads and CD56 MicroBeads (20 µL/$10^7$ cells) were added and incubated for 15 min at 4-8° C. The cells were washed with MACS isolation buffer (1-2 mL/$10^7$ cells). After centrifugation (see above), supernatant was discarded and cells resuspended in MACS isolation buffer (500 µL/$10^8$ cells). CD14/CD56 negative cells were then isolated using LS Columns (Miltenyi Biotec, #130-042-401). PBMC w/o CD14+/CD56+ cells were cultured in RPMI complete medium i.e. RPMI1640 (Biochrom AG, #FG1215) supplemented with 10% FBS (Biochrom AG, #S0115), 1× non-essential amino acids (Biochrom AG, #K0293), 10 mM Hepes buffer (Biochrom AG, #L1613), 1 mM sodium pyruvate (Biochrom AG, #L0473) and 100 U/mL penicillin/streptomycin (Biochrom AG, #A2213) at 37° C. in an incubator until needed.
Target Cell Labeling For the analysis of cell lysis in flow cytometry assays, the fluorescent membrane dye $DiOC_{18}$ (DiO) (Molecular Probes, #V22886) was used to label human CDH19-as target cells and distinguish them from effector cells. Briefly, cells were harvested, washed once with PBS and adjusted to $10^6$ cell/mL in PBS containing 2% (v/v) FBS and the membrane dye DiO (5 µL/$10^6$ cells). After incubation for 3 min at 37° C., cells were washed twice in complete RPMI medium and the cell number adjusted to $1.25\times10^6$ cells/mL. The vitality of cells was determined using 0.5% (v/v) isotonic EosinG solution (Roth, #45380).
Flow Cytometry Based Analysis This assay was designed to quantify the lysis of human CDH19-transfected CHO cells in the presence of serial dilutions of CDH19 bispecific antibodies.

Equal volumes of DiO-labeled target cells and effector cells (i.e., PBMC w/o CD14$^+$ cells) were mixed, resulting in an E:T cell ratio of 10:1. 160 µL of this suspension were transferred to each well of a 96-well plate. 40 µL of serial dilutions of the CDH19 bispecific antibodies and a negative control bispecific (an CD3-based bispecific antibody recognizing an irrelevant target antigen) or RPMI complete medium as an additional negative control were added. The bispecific antibody-mediated cytotoxic reaction proceeded for 48 hours in a 7% $CO_2$ humidified incubator. Then cells were transferred to a new 96-well plate and loss of target cell membrane integrity was monitored by adding propidium iodide (PI) at a final concentration of 1 µg/mL. PI is a membrane impermeable dye that normally is excluded from viable cells, whereas dead cells take it up and become identifiable by fluorescent emission.

Samples were measured by flow cytometry on a FACSCanto II instrument and analyzed by FACSDiva software (both from Becton Dickinson).

Target cells were identified as DiO-positive cells. PI-negative target cells were classified as living target cells. Percentage of cytotoxicity was calculated according to the following formula:

$$\text{Cytotoxicity}[\%] = \frac{n_{dead\ target\ cells}}{n_{target\ cells}} \times 100$$

$n$ = number of events

Figure 7:
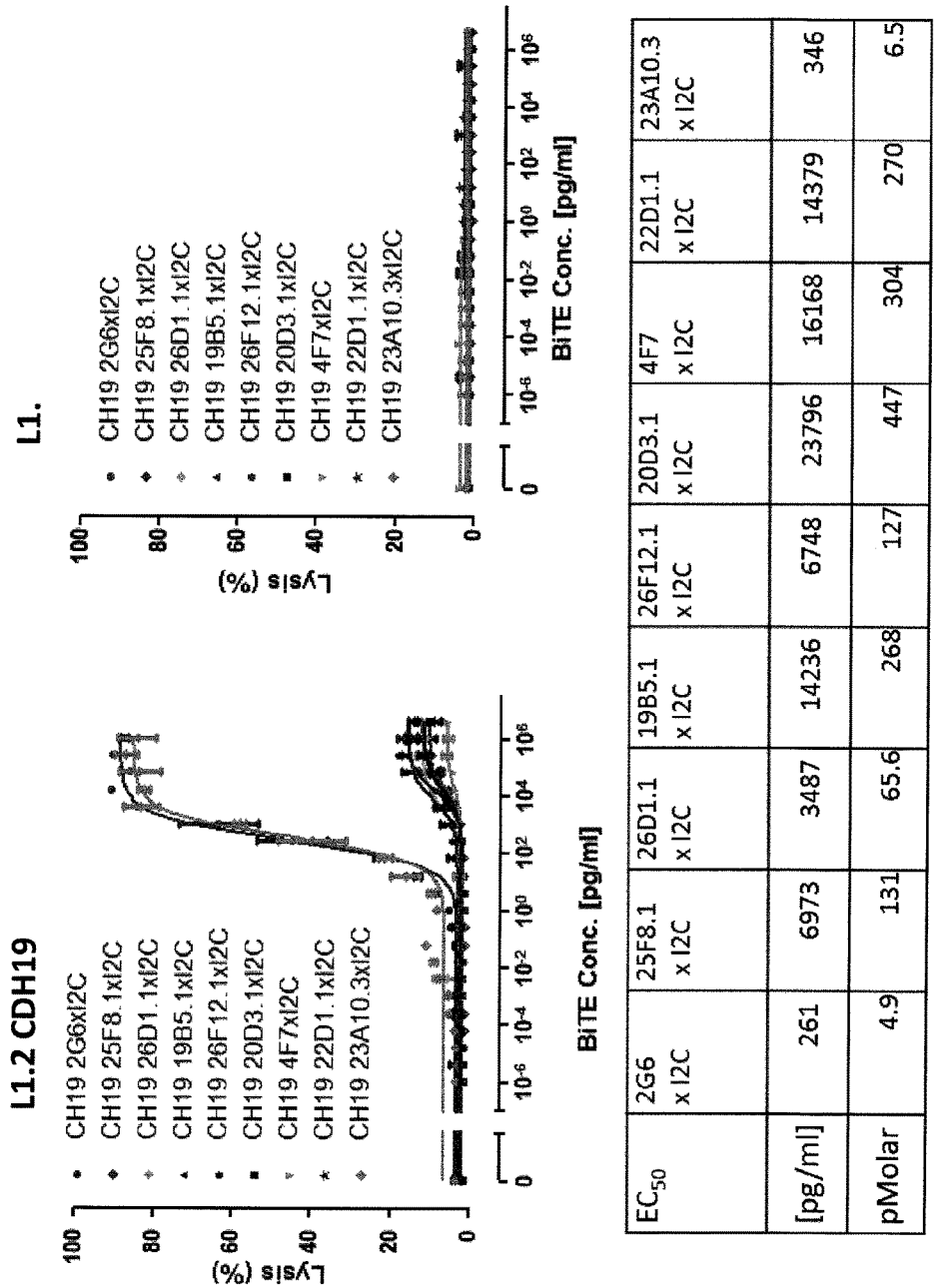
FIG. 7 Cytotoxic activity of CDH19/CD3 bispecific antibodies as measured in a 48-hour FACS-based cytotoxicity assay. Effector cells: unstimulated human PBMC. Target cells: as indicated. Effector to target cell (E:T)-ratio: 10:1.
Figure 7:
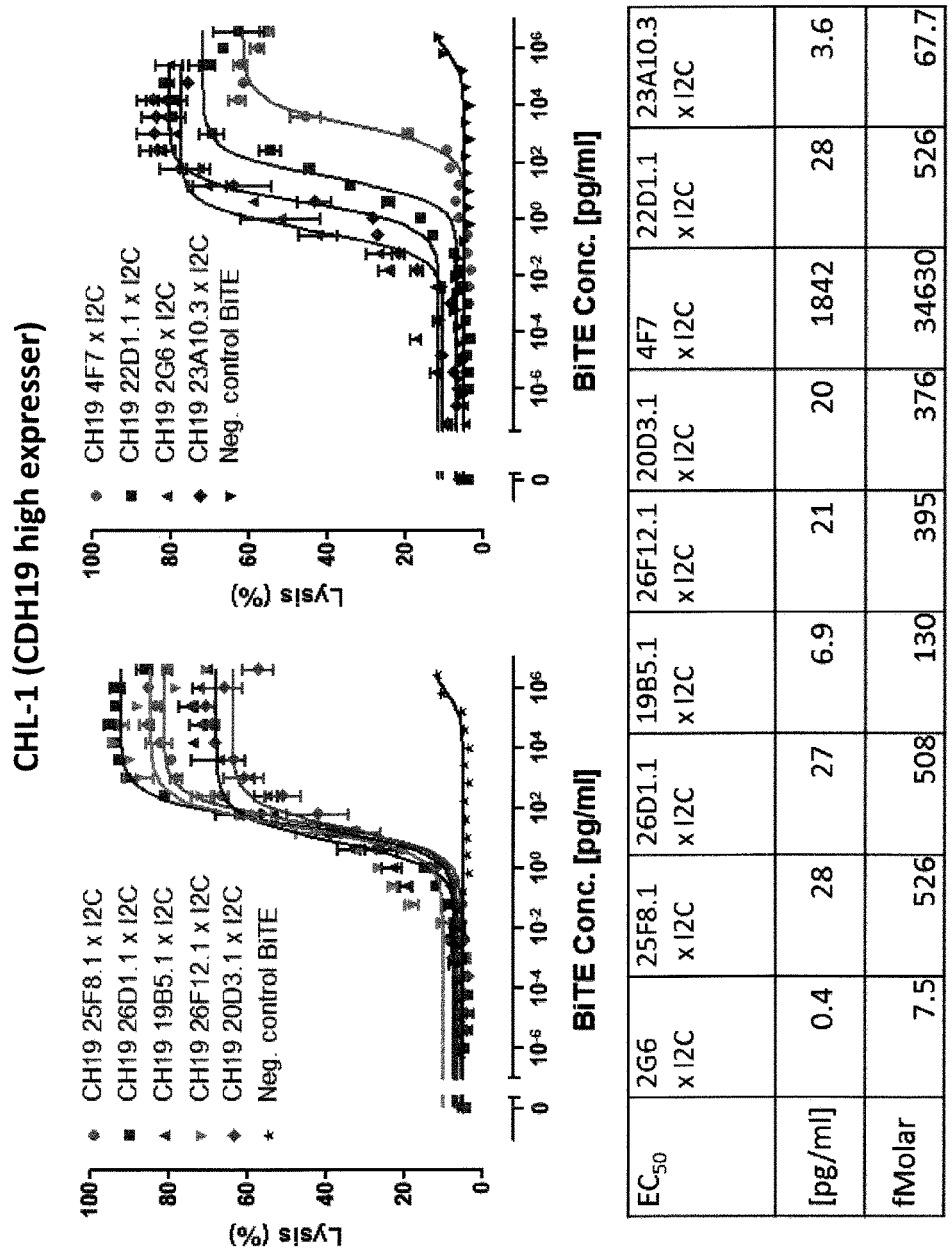

Using GraphPad Prism 5 software (Graph Pad Software, San Diego), the percentage of cytotoxicity was plotted against the corresponding bispecific antibody concentrations. Dose response curves were analyzed with the four parametric logistic regression models for evaluation of sigmoid dose response curves with fixed hill slope and EC50 values were calculated. The results are shown in FIG. 7.

Example 10

In Vivo Tumor Growth Inhibition Experiments 5 million Colo699 or CHL-1 tumor cells were admixed with 2.5 million freshly isolated peripheral blood mononuclear cells (PBMC) and injected subcutaneously in the left flank of female athymic nude mice on Day 0. The same day, mice were treated intraperitoneally with either CDH19 BiTE 2G6 or non-specific control BiTE (MEC14) at the indicated doses. Dosing continued daily for the first 10 days post-tumor inoculation.

Tumor volumes and body weights were measured twice per week using calipers and an analytical scale, respectively.

Figure 8:
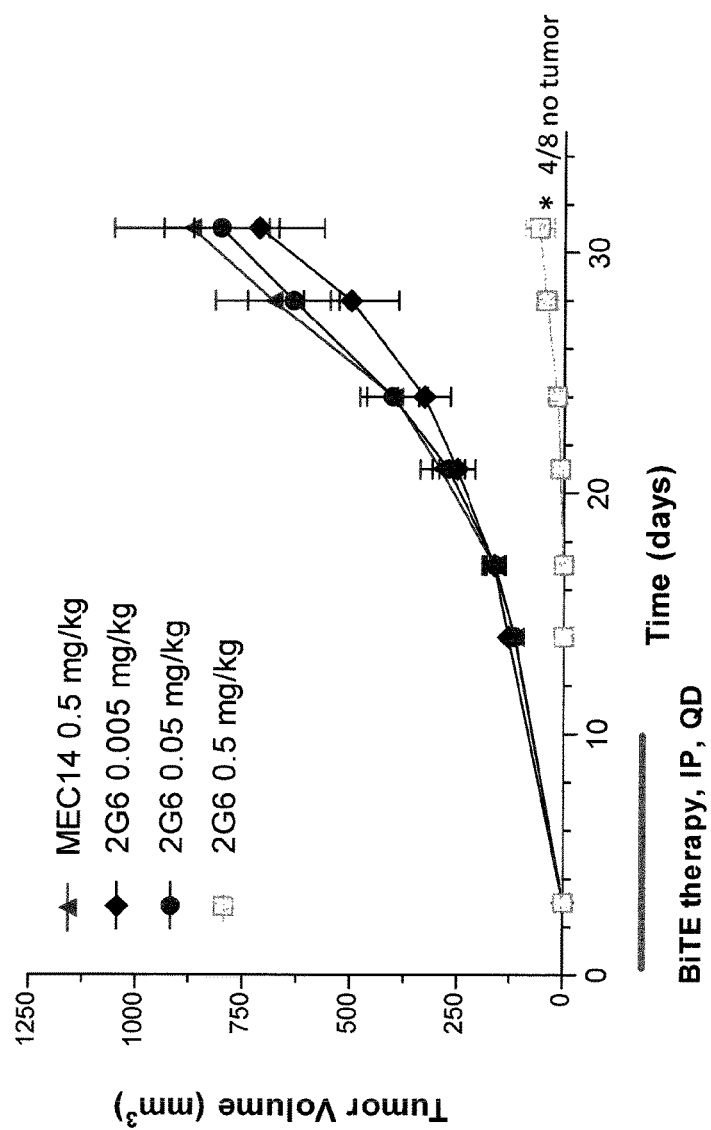
FIG. 8 Tumor growth in vivo inhibition of Colo699 cells by administration of CDH19 BITE 2G6. The bispecific antibody construct inhibits growth of tumors at 0.5 mg/kg dose.
Figure 8:
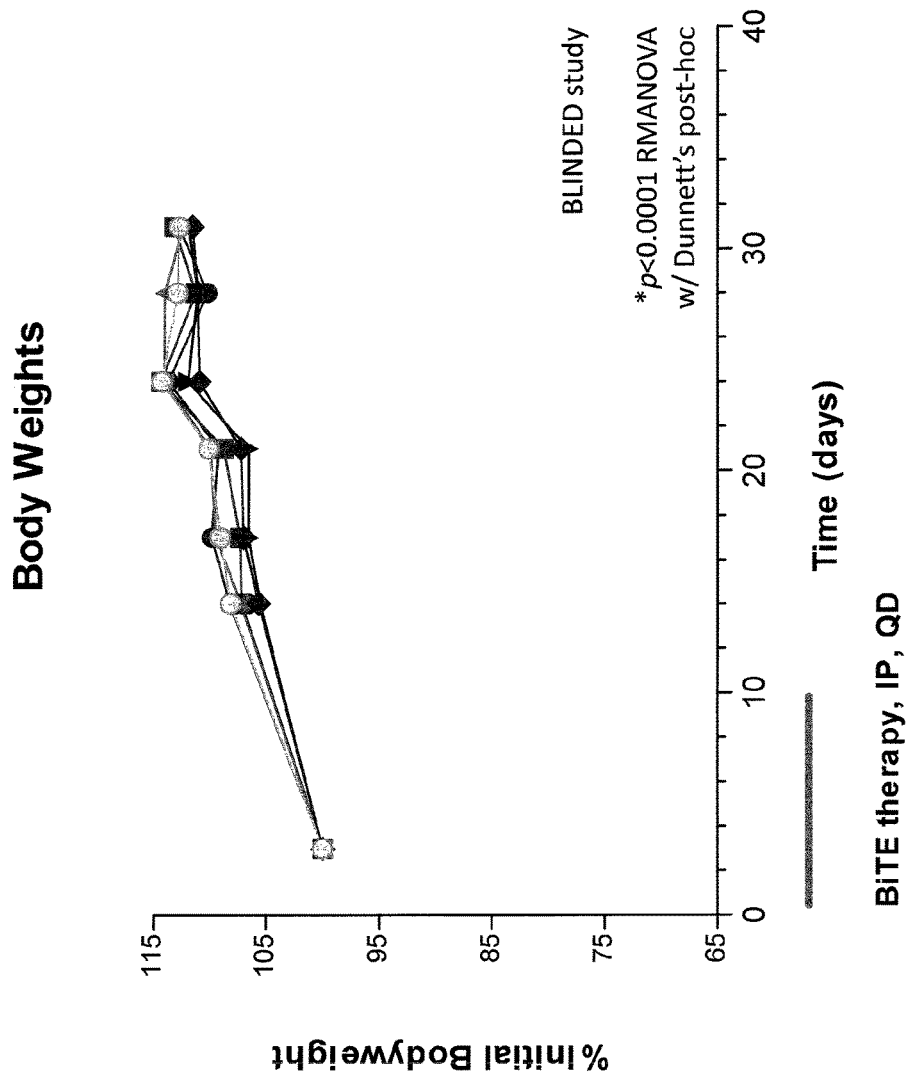
Figure 9:
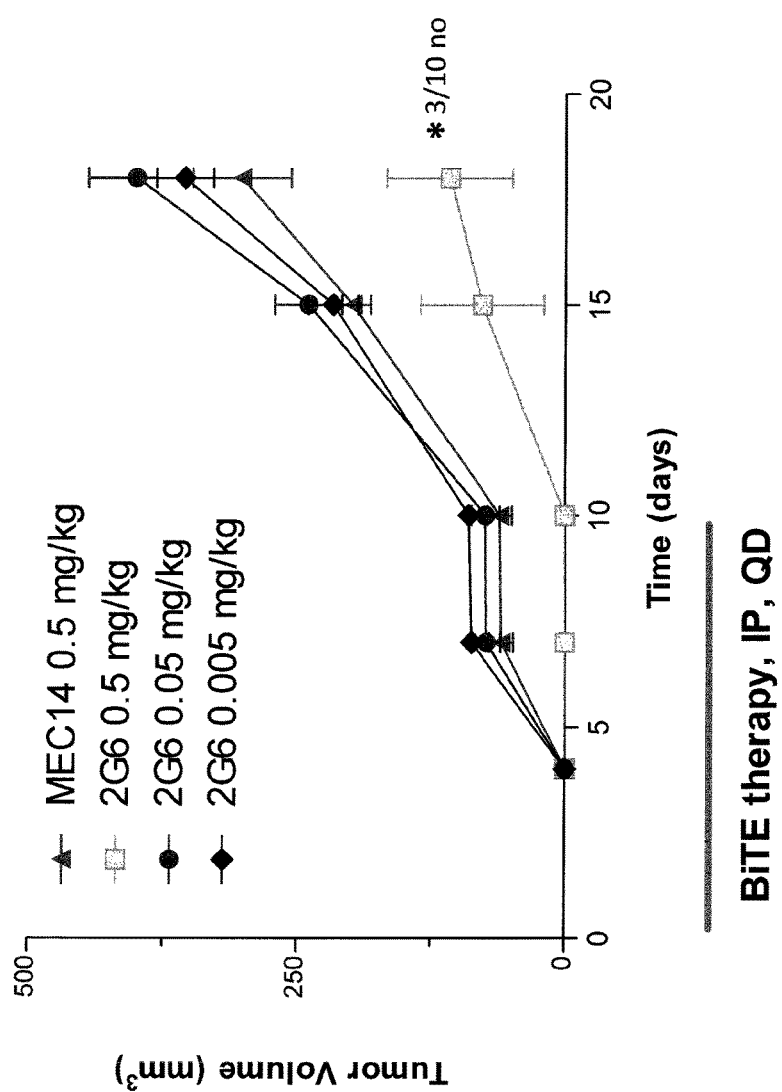
FIG. 9 Tumor growth in vivo inhibition of CHL-1 cells by administration of CDH19 BiTE 2G6. The bispecific antibody construct inhibits growth of tumors at 0.5 mg/kg dose.
Figure 9:
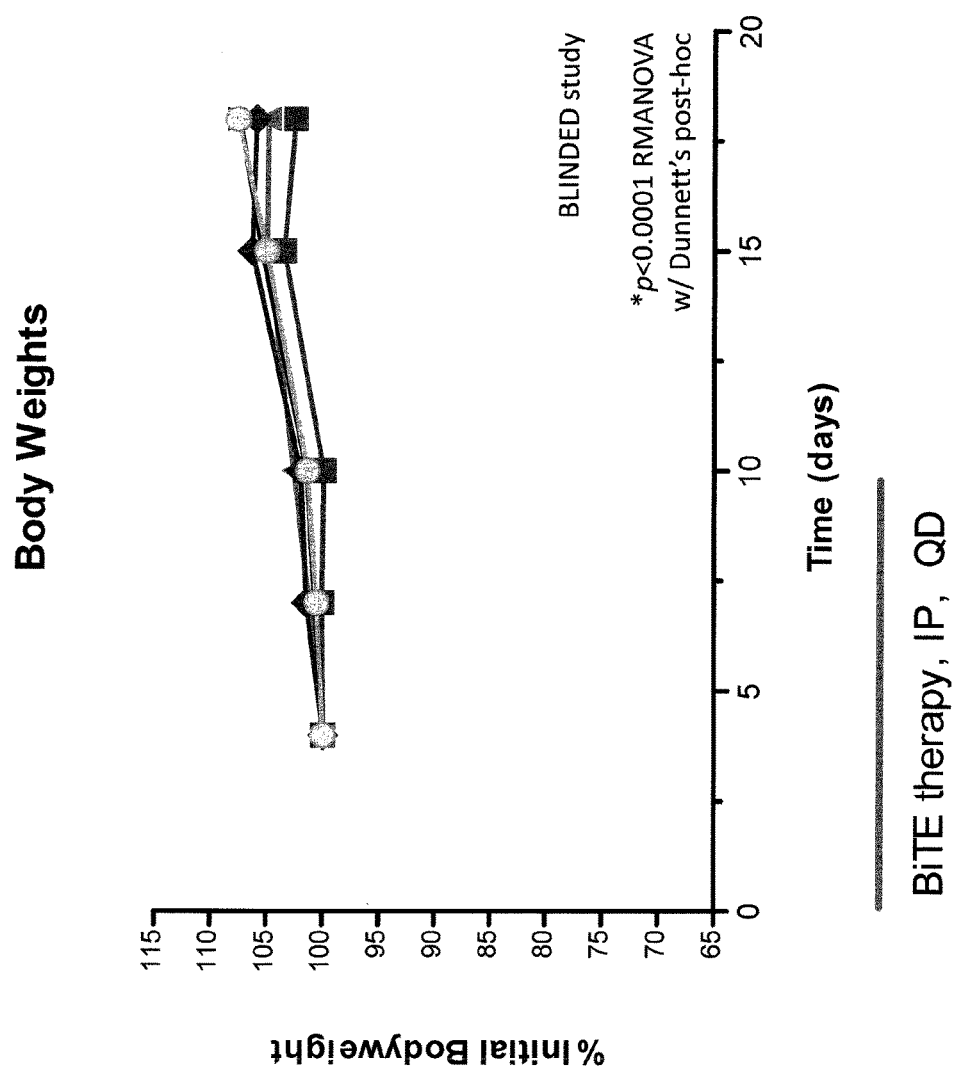

The results of experiments with Colo699 or CHL-1 tumor cells are shown in FIGS. 8 and 9.

Example 11

Cytotoxic Activity
Imaging-based cytotoxicity assay with unstimulated human T-cells
Effector Cells
Purified, naïve human T cells were obtained from AllCells LLC, Alameda, USA.
Image Based Analysis
This assay measures the T cell mediated lysis of melanoma cells. 3000 A2058 cells (CDH19 positive) or 2500 LOX IMVI cells (CDH19 negative) are combined with naïve human T cells in a 1:10 ratio in the wells of 384 well plates. After addition of a serial dilution of CDH19 targeting BiTE molecules as well as a negative control bispecific (a CD3-based bispecific antibody recognizing an irrelevant target antigen), the cells are incubated for 48 h at 37° C. Next, the samples are treated for 2 h with 30 µM Hoechst 33342 to stain the nuclei of all cells and 2 µM propidium iodide (PI) to identify dead cells.

Image acquisition and analysis is performed on a ThermoFisher ArrayScan with a 10× objective. Data for two channels is collected, at 386 nm (Hoechst 33342) and at 549 nm (propidium iodide).

Live cells are identified as Hoechst positive, PI negative events, dead cells as Hoechst positive, PI positive.

Figure 10A:
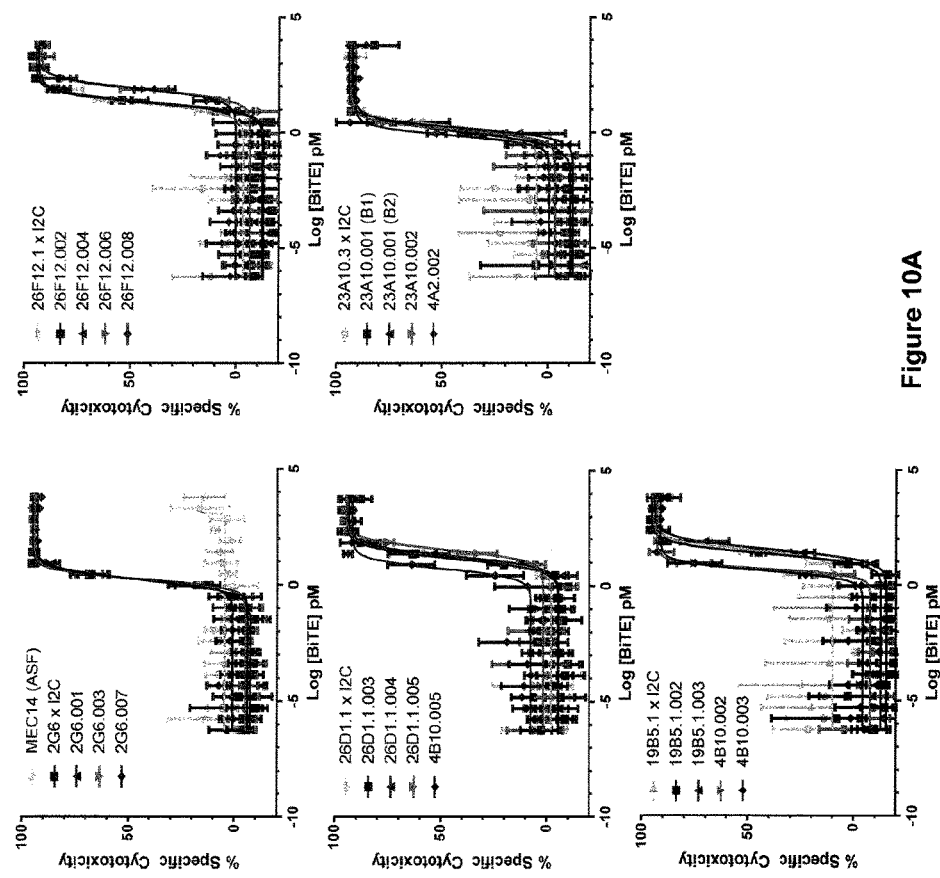
FIG. 10 Cytotoxic activity of CDH19/CD3 bispecific antibodies as measured in a 48-hour imaging-based cytotoxicity assay. Effector cells: unstimulated human T cells. Target cells: as indicated. Effector to target cell (E:T)-ratio: 10:1.
Figure 10B:
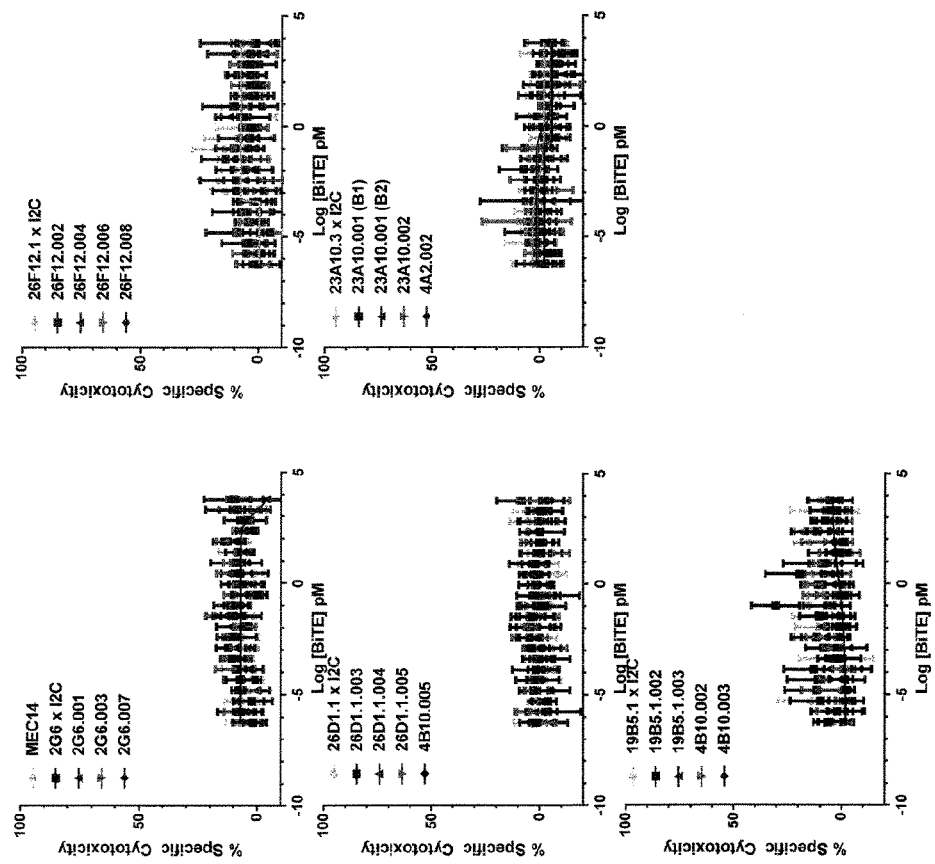

Percentage of cytotoxicity is determined as described in example 7. Representative results are shown in FIG. 10.

Example 12

Domain Specificity and Biochemical Affinity Determination of Bi-Specific Binders
Purification of CDH19 Sub-domains Lacking Post-Translational Modifications A methionine initiation codon followed by nucleotide sequences encoding CDH19 sub-domain protein A=huCDH19(140-367 of SEQ ID NO:944), immediately preceding a G$_4$S linker and poly-Histidine tag was cloned into a suitable pET vector; whereas, nucleotides sequences encoding sub-domain proteins B=huCDH19(44-367 of SEQ ID NO:944) and C=rhCDH19(44-367 of SEQ ID NO:1457) were cloned into the pET-SUMO vector (Life Technologies, Invitrogen) by methods known in the art. Each was expressed in E. coli, isolated from the soluble fraction and purified to homogeneity by metal chelate affinity chromatography, followed by anion exchange, and size exclusion chromatography in HEPES buffered saline, 3 mM CaCl2, pH 8. Sub-domain protein A retained its linker and C terminal polyhistidine tag, but His-SUMO tags constituent to the N termini of proteins B and C were removed by digestion with SUMO protease (Life Technologies, Invitrogen) prior to anion exchange. All proteins were determined to have their expected molecular weight by ESI LC/MS. Proteins used in binding experiments described below were randomly biotinylated by typical methods known in the art.
Purification of CDH19 Sub-domains with Post-translational Modifications CDH19 sub-domain proteins D=huCDH19(44-367 of SEQ ID NO:944), and E=rhCDH19(44-367 of SEQ ID NO:1457) were generated by cloning nucleotide sequences encoding respective amino acid residues 1-367 into the pSURETech235b vector (Selexis) each immediately preceded a G$_4$S linker and poly-Histidine tag were cloned into the pSURETech235b vector (Selexis), transfected into CHO-S cells (Life Technologies, Invitrogen), and stable pools were generated following hygromycin selection by methods known in the art. Stable pools were expanded and conditioned media was collected after 7 days culture in serum free media. CM was exchanged by UF/DF with 5 diavolumes HEPES buffered saline plus CaCl$_2$ using a 1 sq ft 10K PES Pellicon 2 membrane and purified to homogeneity as described above. CDH19 sub-domain proteins D and E retained constituent linker and C terminal polyhistidine tags. N terminal sequence of each protein was determined to be G44 as expected, while ESI LC/MS of purified proteins as compared with same subjected to PNGase F digestion revealed the presence of both N- and O-linked glycans. Proteins used in binding experiments described below were randomly biotinylated by methods well known in the art.
Methods for Binding Affinity Determination by Octet The Octet RED384 biosensor was used to characterize kinetics and affinity of protein-protein interactions. Minimally biotinylated CDH19 domain target proteins A-E were bound to streptavidin tips in the machine while serial dilutions of analyte bi-specific binder proteins were made in 96-well or 384-well plates. Empirical target loading conditions were found from assay development to be 10-20 nM target concentration and loading for 600 seconds to give a 2 nm signal. Binding experiments were performed by setting up a plate with 6-point (Tables 7-9) or 3-point (Table 10) 1:3 serial dilutions from 30 nM starting concentrations of each analyte, with two reference wells per column having buffer alone. Octet Buffer: 10 mM HEPES (pH 7.5), 150 mM NaCl, +/−1 mM CaCl$_2$, 0.13% Triton X-100 and 0.10 mg/ml BSA. Additional baseline and dissociation wells in the plate also contained buffer alone. The binding method was as follows: ForteBio Octet streptavidin tips were (1) soaked in buffer for 10 minutes; (2) transferred to the plate baseline wells and incubated for 5 minutes; (3) transferred to the target loading wells and incubated for 10 minutes; (4) transferred to the plate baseline wells and incubated for 5 minutes; (5) transferred to the sample wells and incubated for 5 minutes (Table 9) or 20 minutes (Tables 7, 8, 10); (6) transferred to the dissociation wells and incubated for 8.3 minutes (Table 9) or 1.5 hr (Tables 7, 8, 10). Raw data was processed in the following manner: (a) reference tip curves were averaged and subtracted from sample curves; (b) the association and dissociation curves were isolated and aligned to the Y axis; (c) the association and dissociation interstep was aligned; (d) Savitzky-Golay filtering was implemented to reduce the signal noise and (e) the resulting set of association and dissociation curves for each sample-target interaction were fit globally with a single 1:1 binding model to determine the measured values of the association (Ka) and dissociation (Kd) rate constants to calculate the equilibrium dissociation constant, KD.

TABLE 7

Domain Specificity and Biochemical Affinity of Bi-specific Binders to Isolated human CDH19 Protein Domains Lacking Post Translational Modifications

| | | A = huCDH19(140-367) $E$ $coli$ | | | B = huCDH19(44-367) $E$ $coli$ | | | Predicted |
|---|---|---|---|---|---|---|---|---|
| Clone ID | Bispecific binder ID | KD (nM) | ka (M-1s-1) | kd (s-1) | KD (pM) | ka (M-1s-1) | kd (s-1) | Epitope Region |
| 2G6 | 65254 | <0.03 | 3.37E+05 | <1.0E−05 | <0.04 | 2.31E+05 | <1.0E−05 | 250-364 Bin B.1 |
| 26F12 | 65251 | (−) | (−) | (−) | 0.20 | 3.86E+05 | 7.56E−05 | 44-114 Bin A.2 |

(−) negative binding, 20 min association, 1.5 hr dissociation
Legend Table 7
Human CDH19 Protein domains lacking post translational modifications
A = $E$ $coli$ expressed huCDH19(140-367) of SEQ ID NO: 944)
B = $E$ $coli$ expressed huCDH19(44-367) of SEQ ID NO: 944)

The data summarized in table 7 confirmed CDH19 epitope region specificity of bi-specific binders and allowed for their relative affinity ranking.

TABLE 8

Calcium Modulated Biochemical Affinity of Bi-specific Binders to Isolated Human and Macaque CDH19 Protein Domains Lacking Post Translational Modifications

| | | B = huCDH19(44-367) $E$ $coli$ | | | C = rhCDH19(44-367) $E$ $coli$ | | | |
|---|---|---|---|---|---|---|---|---|
| Clone ID, Epitope Bin | Bispecific binder ID | KD (nM) | ka (M-1s-1) | kd (s-1) | KD (nM) | ka (M-1s-1) | kd (s-1) | $CaCl_2$ |
| 2G6, Bin B.1 | 65254 | <0.06 | 1.66E+05 | <1.0E−05 | <0.03 | 2.97E+05 | <1.0E−05 | 1 mM |
| 26F12, Bin A.2 | 65251 | 0.31 | 2.91E+05 | 9.0E−05 | 0.17 | 8.19E+05 | 1.36E−04 | 1 mM |
| 2G6, Bin B.1 | 65254 | (−) | (−) | (−) | (−) | (−) | (−) | absent |
| 26F12, Bin A.2 | 65251 | 2.56 | 1.21E+05 | 3.08E−04 | 1.16 | 4.68E+05 | 5.44E−04 | absent |

(−) negative binding, 20 min association, 1.5 hr dissociation
Legend Table 8
CDH19 Protein domains lacking post translational modifications
B = $E$ $coli$ expressed huCDH19(44-367) of SEQ ID NO: 944)
C = $E$ $coli$ expressed rhCDH19(44-367) of SEQ ID NO: 1457)

The data summarized in table 8 allowed determination of calcium sensitivity of bi-specific binders and for their relative affinity ranking. Data further suggests conformational epitopes, with Bin B.1 more dependent on CDH19/Ca2+ association than epitope Bin A.2

TABLE 9

Biochemical Affinity of Bi-specific Binders to Isolated Human and Macaque CDH19 Protein Domains Lacking Post Translational Modifications

| | | B = huCDH19(44-367) $E$ $coli$ | | | C = rhCDH19(44-367) $E$ $coli$ | | |
|---|---|---|---|---|---|---|---|
| Clone ID | Bispecific binder ID | KD (nM) | ka (M-1s-1) | kd (s-1) | KD (nM) | ka (M-1s-1) | kd (s-1) |
| 2G6 | 65254 | <0.3 | 3.11E+05 | <1.0E−04 | <0.3 | 3.69E+05 | <1.0E−04 |
| 2G6.001 | 65254.001 | <0.4 | 2.21E+05 | <1.0E−04 | <0.4 | 2.42E+05 | <1.0E−04 |

TABLE 9-continued

Biochemical Affinity of Bi-specific Binders to Isolated Human and Macaque
CDH19 Protein Domains Lacking Post Translational Modifications

| Clone ID | Bispecific binder ID | B = huCDH19(44-367) E coli | | | C = rhCDH19(44-367) E coli | | |
|---|---|---|---|---|---|---|---|
| | | KD (nM) | ka (M-1s-1) | kd (s-1) | KD (nM) | ka (M-1s-1) | kd (s-1) |
| 2G6.003 | 65254.003 | <0.5 | 1.80E+05 | <1.0E−04 | <0.5 | 1.91E+05 | <1.0E−04 |
| 2G6.007 | 65254.007 | 0.57 | 2.95E+05 | 1.69E−04 | 0.55 | 3.53E+05 | 1.94E−04 |
| 4A2.002 | 65238.002 | <0.2 | 5.48E+05 | <1.0E−04 | <0.1 | 9.13E+05 | <1.0E−04 |
| 4B10.002 | 65240.002 | <0.2 | 5.02E+05 | <1.0E−04 | <0.1 | 7.48E+05 | <1.0E−04 |
| 4B10.003 | 65240.003 | <0.2 | 3.87E+05 | <1.0E−04 | <0.2 | 5.06E+05 | <1.0E−04 |
| 4B10.005 | 65240.005 | <0.2 | 4.41E+05 | <1.0E−04 | <0.2 | 6.00E+05 | <1.0E−04 |
| 19B5.1.002 | 65235.002 | 1.74 | 3.74E+05 | 6.49E−04 | 1.02 | 4.94E+05 | 5.02E−04 |
| 19B5.1.003 | 65235.003 | 2.44 | 3.09E+05 | 7.54E−04 | 1.63 | 3.97E+05 | 6.45E−04 |
| 23A10.001 (B1) | 65237.001 | <0.4 | 2.55E+05 | <1.0E−04 | <0.3 | 3.16E+05 | <1.0E−04 |
| 23A10.001 (B2) | 65237b.001 | 0.57 | 2.95E+05 | 1.69E−04 | 0.55 | 3.53E+05 | 1.94E−04 |
| 23A10.002 | 65237.002 | <0.3 | 2.86E+05 | <1.0E−04 | <0.3 | 3.61E+05 | <1.0E−04 |
| 26D1.1.003 | 65250.003 | 0.66 | 3.64E+05 | 2.41E−04 | 0.50 | 5.20E+05 | 2.62E−04 |
| 26D1.1.004 | 65250.004 | 1.08 | 3.39E+05 | 3.67E−04 | 0.65 | 4.66E+05 | 3.02E−04 |
| 26D1.1.005 | 65250.005 | 2.65 | 3.19E+05 | 8.44E−04 | 1.42 | 4.42E+05 | 6.25E−04 |
| 26F12.002 | 65251.002 | 0.97 | 3.25E+05 | 3.16E−04 | 1.70 | 4.33E+05 | 7.36E−04 |
| 26F12.004 | 65251.004 | 1.04 | 2.90E+05 | 3.00E−04 | 1.85 | 3.46E+05 | 6.38E−04 |
| 26F12.006 | 65251.006 | 3.96 | 4.10E+05 | 1.62E−03 | 5.39 | 5.95E+05 | 3.21E−03 |
| 26F12.008 | 65251.008 | 3.77 | 4.87E+05 | 1.84E−03 | 5.14 | 7.45E+05 | 3.83E−03 |

1 mM CaCl$_2$, 5 min association, 8.3 min dissociation
Legend Table 9
CDH19 Protein domains lacking post translational modifications
B = E coli expressed huCDH19(44-367) of SEQ ID NO: 944)
C = E coli expressed rhCDH19(44-367) of SEQ ID NO: 1457)

The data summarized in table 9 allowed relative affinity ranking of bi-specific binders to human and non-human primate CDH19 domains lacking glycosylation.

TABLE 10

Calcium Modulated Biochemical Affinity of Bi-specific Binders to Isolated
Glycosylated Human and Macaque CDH19 Protein Domains

| Clone ID, Epitope Bin | Bispecific binder ID | D = huCDH19(44-367) CHO | | | E = rhCDH19(44-367) CHO | | | |
|---|---|---|---|---|---|---|---|---|
| | | KD (nM) | ka (M-1s-1) | kd (s-1) | KD (nM) | ka (M-1s-1) | kd (s-1) | CaCl$_2$ |
| 2G6, Bin B.1 | 65254 | <0.041 | 2.44E+05 | <1.0E−05 | <0.031 | 3.19E+05 | <1.0E−05 | 1 mM |
| 2G6.003, Bin B.1 | 65254.003 | <0.099 | 1.01E+05 | <1.0E−05 | <0.09 | 1.10E+05 | <1.0E−05 | 1 mM |
| 4B10.003, Bin B.2 | 65240.003 | 0.24 | 2.08E+05 | 4.91E−05 | 0.29 | 2.70E+05 | 7.88E−05 | 1 mM |
| 19B5.1.003, Bin A.2 | 65235.003 | 1.01 | 4.02E+05 | 4.07E−04 | 0.27 | 7.12E+05 | 1.93E−04 | 1 mM |
| 23A10.002, Bin B.1 | 65237.002 | <0.036 | 2.75E+05 | <1.0E−05 | <0.035 | 2.82E+05 | <1.0E−05 | 1 mM |
| 26D1.1.005, Bin A.2 | 65250.005 | 0.97 | 3.13E+05 | 3.04E−04 | 0.37 | 4.64E+05 | 1.74E−04 | 1 mM |
| 26F12, Bin A.2 | 65251 | 0.28 | 5.28E+05 | 1.50E−04 | 0.22 | 8.72E+05 | 1.94E−04 | 1 mM |
| 26F12.006, Bin A.2 | 65251.006 | 1.24 | 4.92E+05 | 6.07E−04 | 1.13 | 6.94E+05 | 7.86E−04 | 1 mM |
| 2G6, Bin B.1 | 65254 | (−) | (−) | (−) | (−) | (−) | (−) | absent |
| 2G6.003, Bin B.1 | 65254.003 | (−) | (−) | (−) | (−) | (−) | (−) | absent |
| 4B10.003, Bin B.2 | 65240.003 | (−) | (−) | (−) | (−) | (−) | (−) | absent |
| 19B5.1.003, Bin A.2 | 65235.003 | 3.49 | 2.90E+05 | 1.01E−03 | 3.28 | 2.65E+05 | 8.68E−04 | absent |
| 23A10.002, Bin B.1 | 65237.002 | (−) | (−) | (−) | (−) | (−) | (−) | absent |
| 26D1.1.005, Bin A.2 | 65250.005 | 0.86 | 4.12E+05 | 3.56E−04 | 2.58 | 3.26E+05 | 8.41E−04 | absent |
| 26F12, Bin A.2 | 65251 | 1.91 | 2.66E+05 | 5.09E−04 | 1.09 | 5.38E+05 | 5.88E−04 | absent |

TABLE 10-continued

Calcium Modulated Biochemical Affinity of Bi-specific Binders to Isolated Glycosylated Human and Macaque CDH19 Protein Domains

| | | D = huCDH19(44-367) CHO | | | E = rhCDH19(44-367) CHO | | | |
| --- | --- | --- | --- | --- | --- | --- | --- | --- |
| Clone ID, Epitope Bin | Bispecific binder ID | KD (nM) | ka (M-1s-1) | kd (s-1) | KD (nM) | ka (M-1s-1) | kd (s-1) | CaCl$_2$ |
| 26F12.006, Bin A.2 | 65251.006 | 0.79 | 6.29E+05 | 4.95E−04 | 18.53 | 3.36E+05 | 6.22E−03 | absent |

(−) negative binding, 20 min association, 1.5 hr dissociation
Legend Table 10
Glycosylated CDH19 Protein domains
D = CHO expressed huCDH19(44-367 of SEQ ID NO: 944)
E = CHO expressed rhCDH19(44-367 of SEQ ID NO: 1457)

The data summarized in table 10 allowed determination of calcium sensitivity of bi-specific binders and relative affinity ranking toward glycosylated human and non-human primate CDH19 domain proteins. As compared to data in Table 8, affinities are similar to those with domains lacking post-translational modifications. Data further suggests conformational epitopes, with epitope Bins B.1 and B.2 being more dependent on CDH19/Ca2+ association than epitope Bin A.2

Example 13

Bispecific Binding and Interspecies Cross-reactivity:

For confirmation of binding to human CDH19 and to human CD3, bispecific antibodies were tested by flow cytometry using indicated cell lines. HEK293 transfected with human CDH19 (see example 14) and CD3-expressing human T cell leukemia cell line HPB-ALL (DSMZ, Braunschweig, ACC483) were used as antigen positive cell lines.

For flow cytometry 200,000 cells of the respective cell lines were incubated for 30 min on ice with 100 µl of BITE containing cell culture supernatant. The cells were washed twice in PBS/2% FCS and binding of the constructs was detected with a murine anti-CD3scFv antibody (3E5.A5, Amgen; diluted to 2 µg/ml PBS/2% FCS). After washing, bound anti-CD3scFv antibodies were detected with an Fc gamma-specific antibody (Dianova) conjugated to phycoerythrin, diluted 1:100 in PBS/2% FCS. Samples were measured by flow cytometry on a FACSCanto II instrument and analyzed by FACSDiva software (both from Becton Dickinson).

Figure 19:
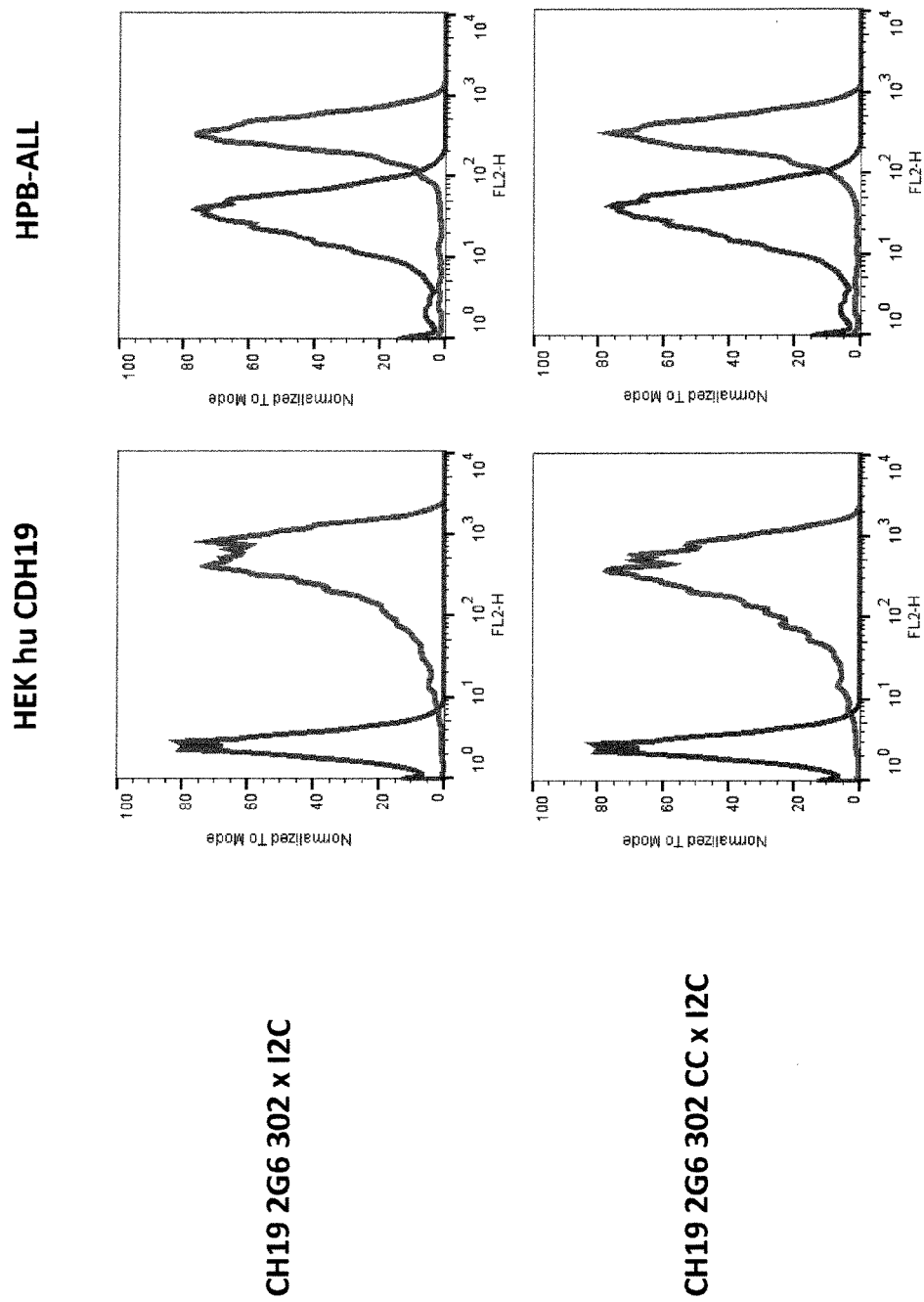
FIG. 19 FACS analysis of CDH19/CD3 bispecific antibodies on indicated cell lines: 1) HEK293 cells stably transfected with human CDH19, 2) human CD3 positive human T cell line HBP-ALL; Negative controls [1) and 2)]: detection antibodies without prior CDH19/CD3 bispecific antibody cell culture supernatant.
Figure 19:
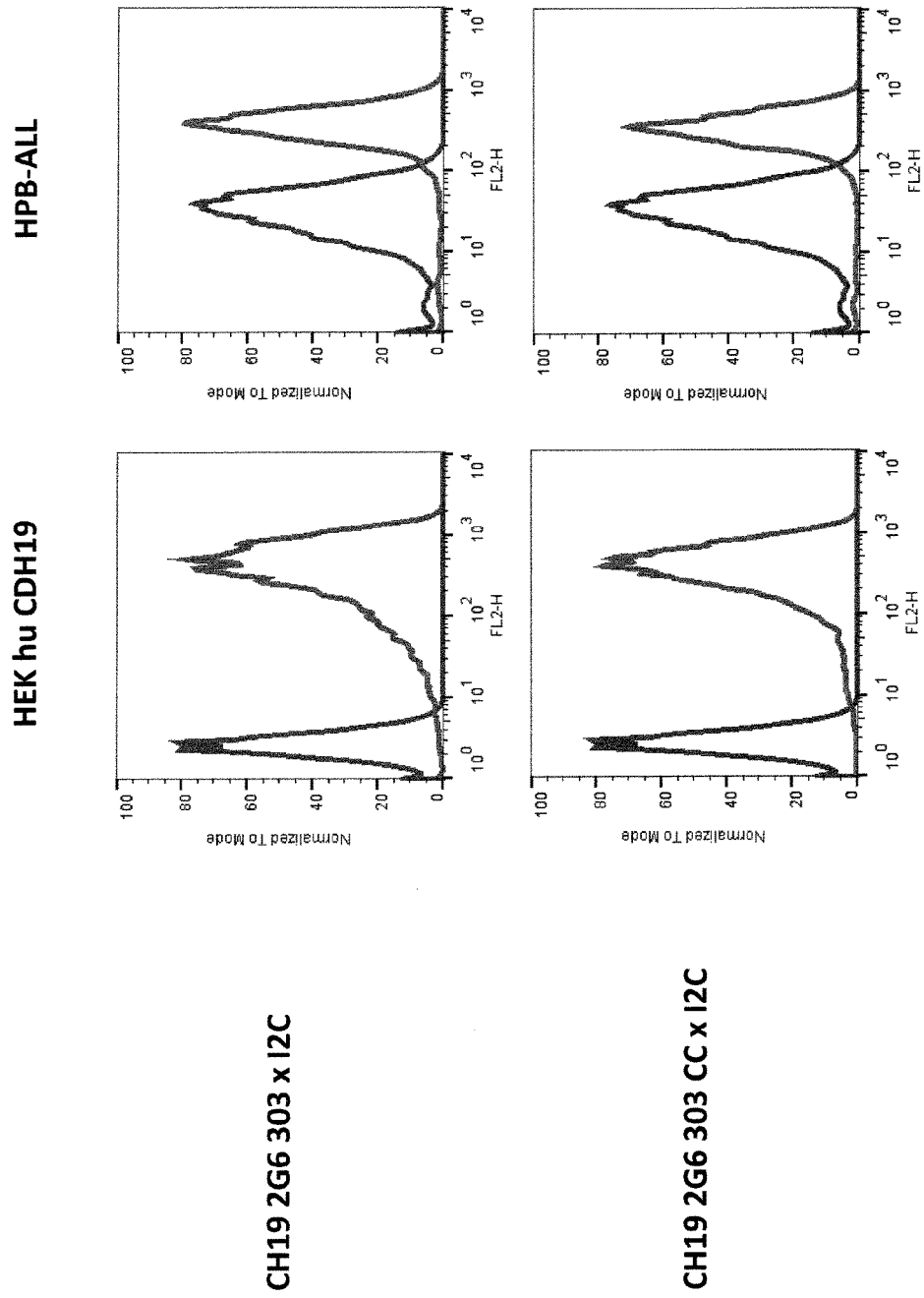
Figure 19:
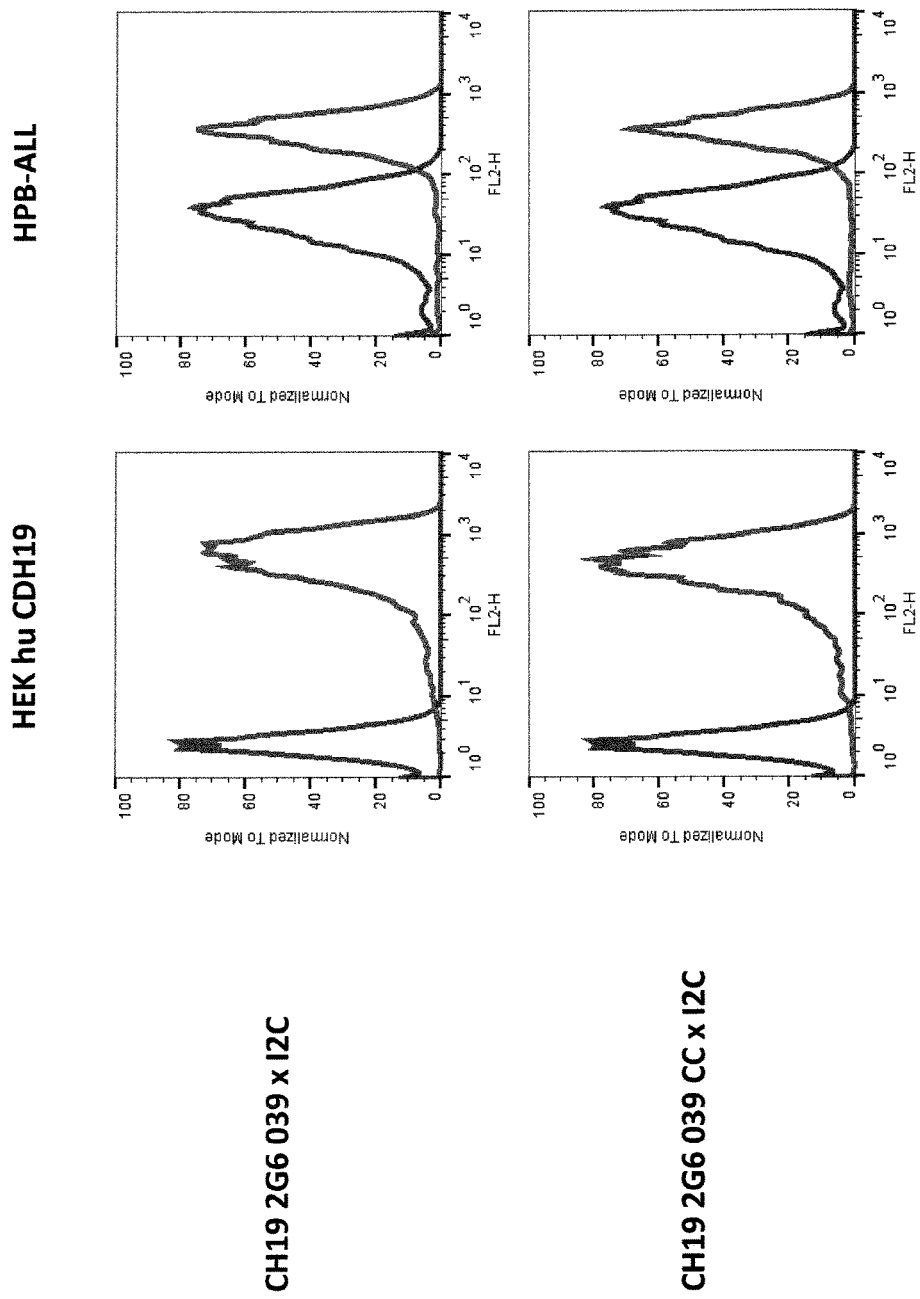
Figure 19:
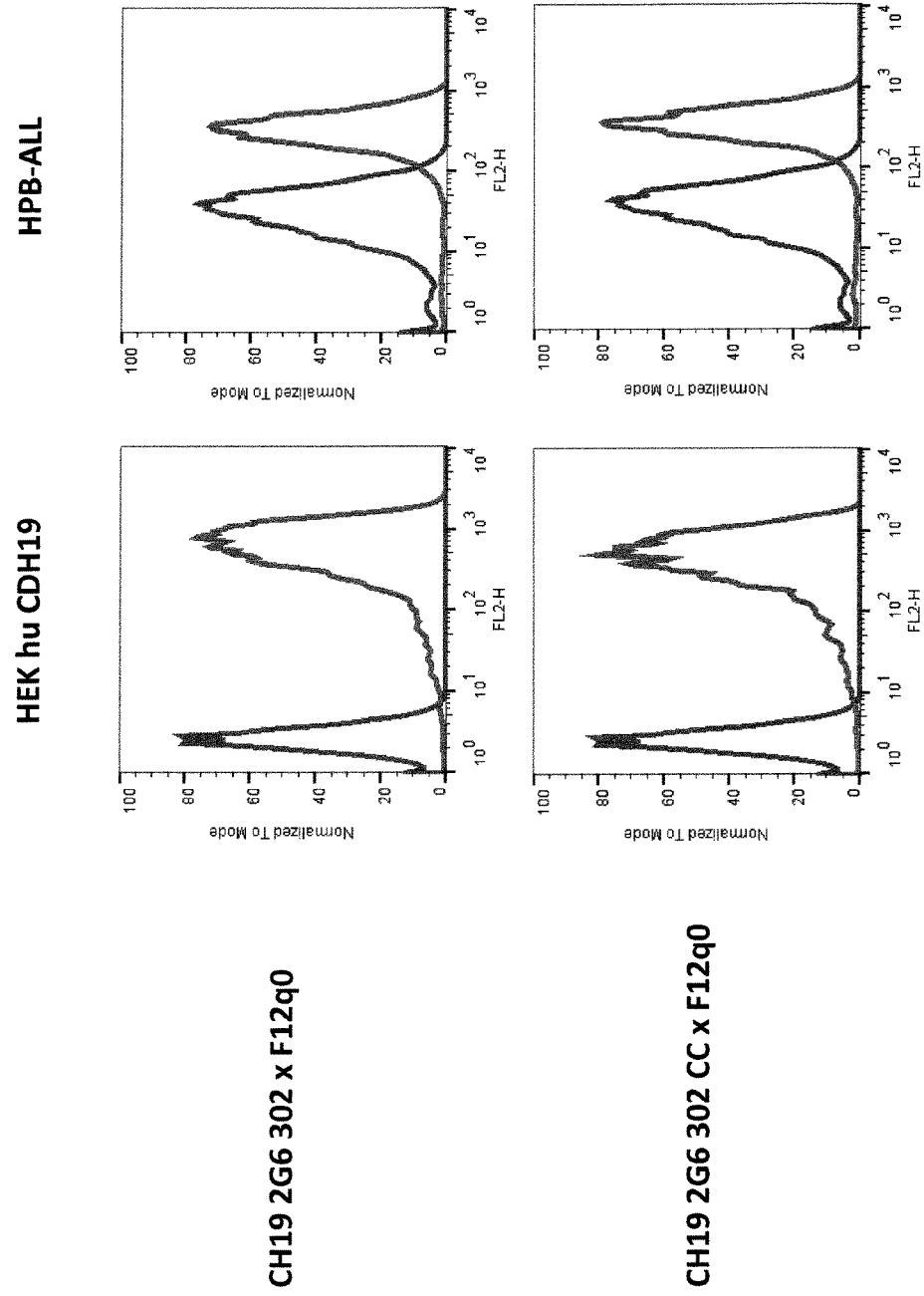
Figure 19:
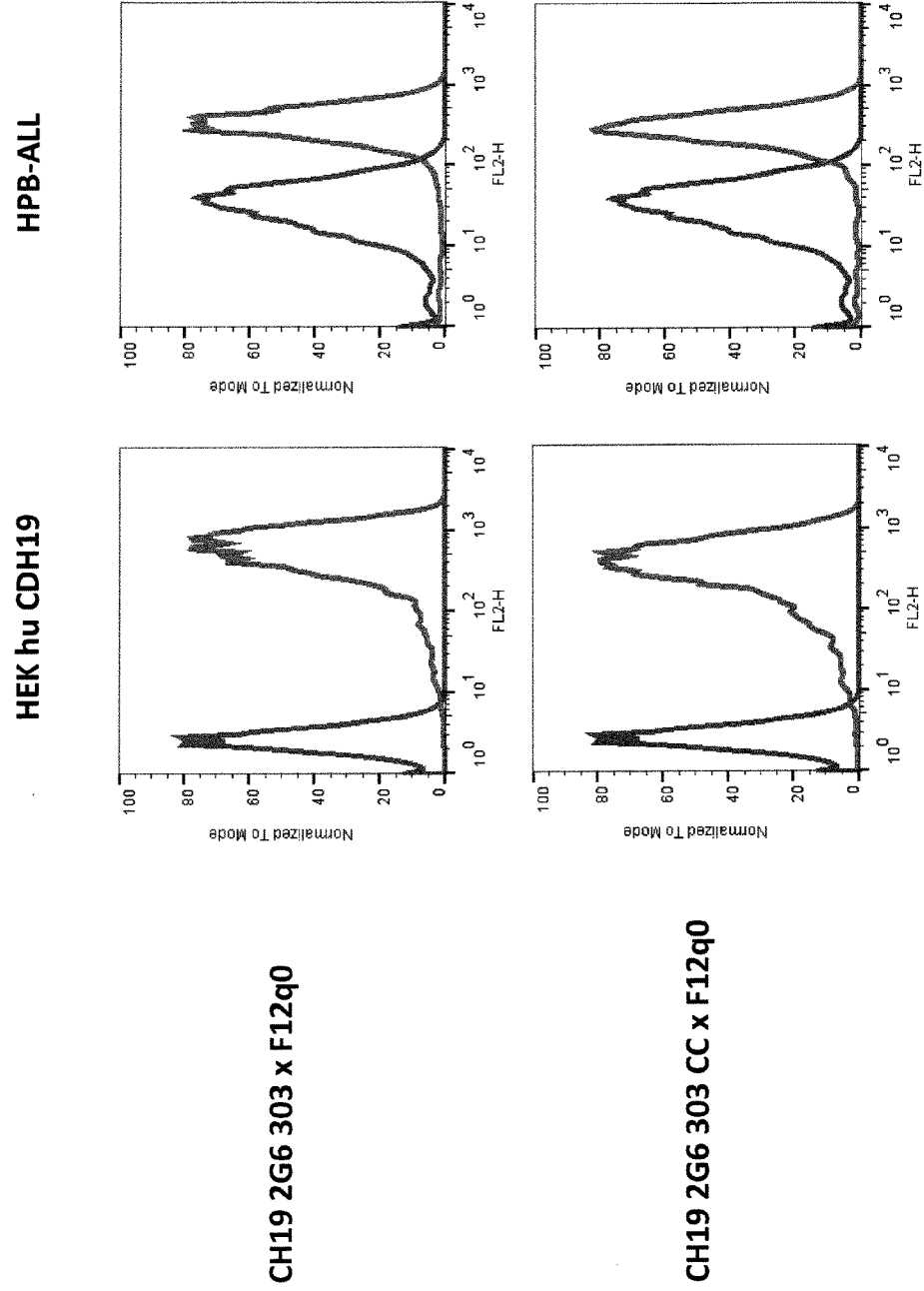
Figure 19:
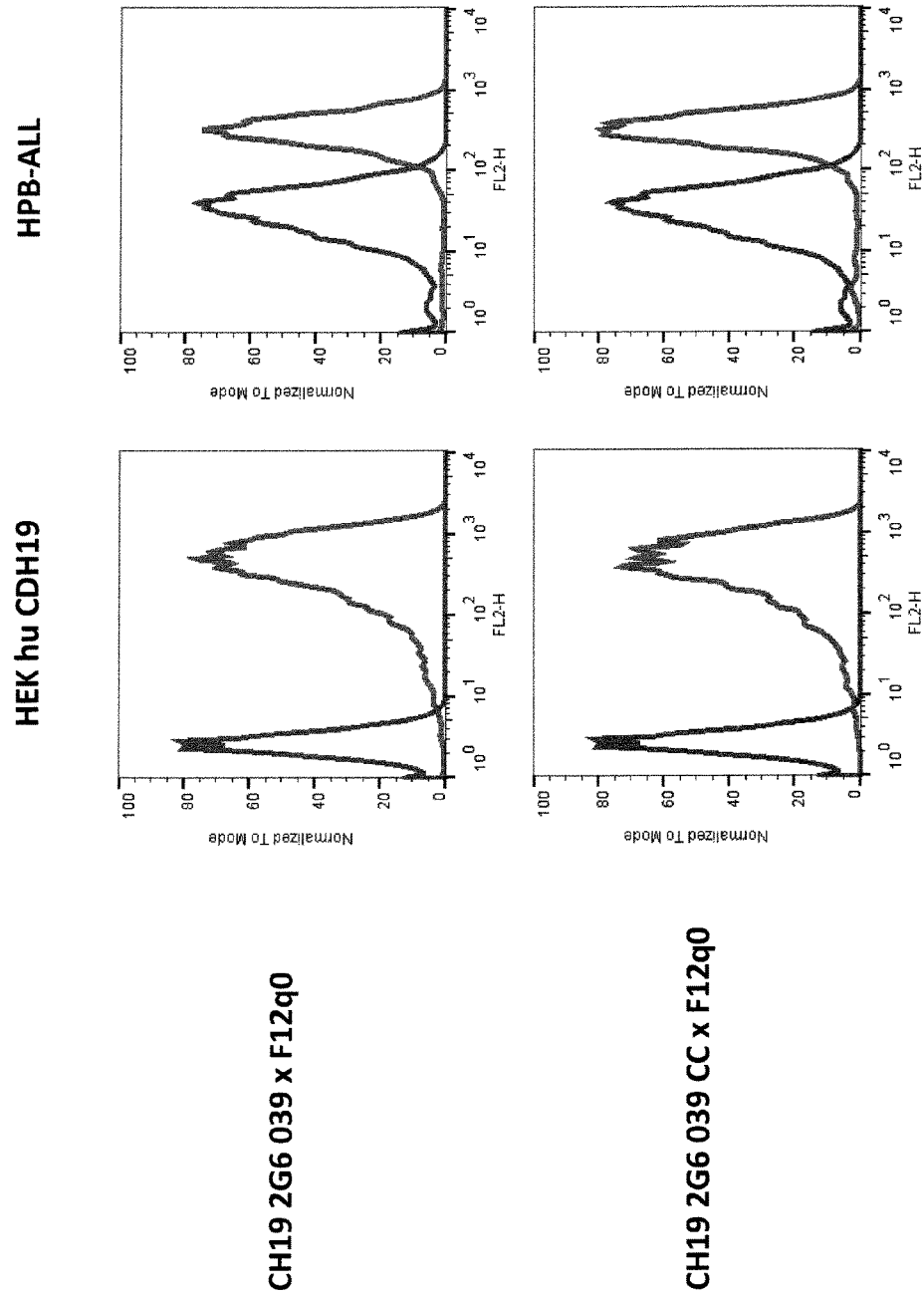
Figure 19:
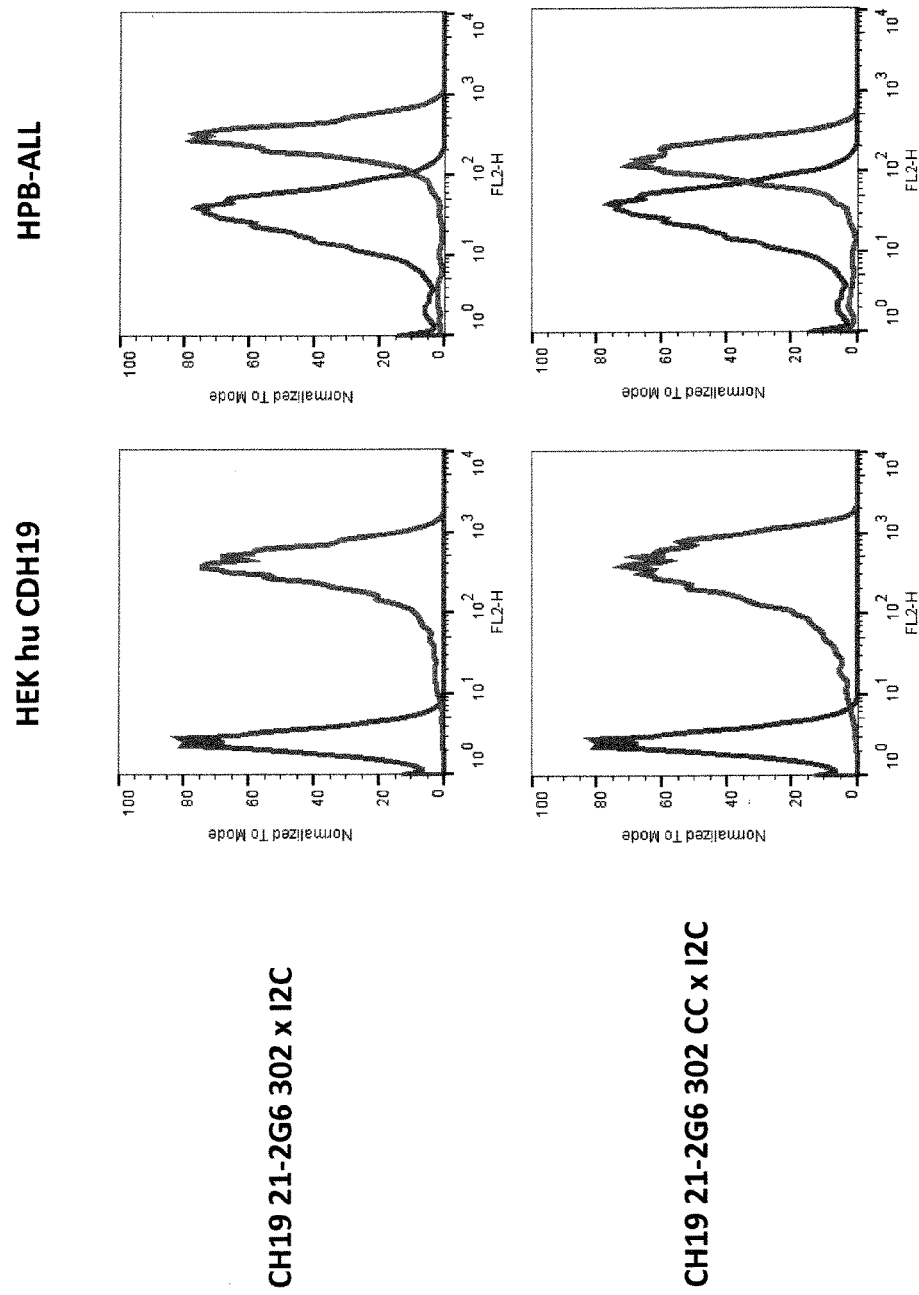
Figure 19:
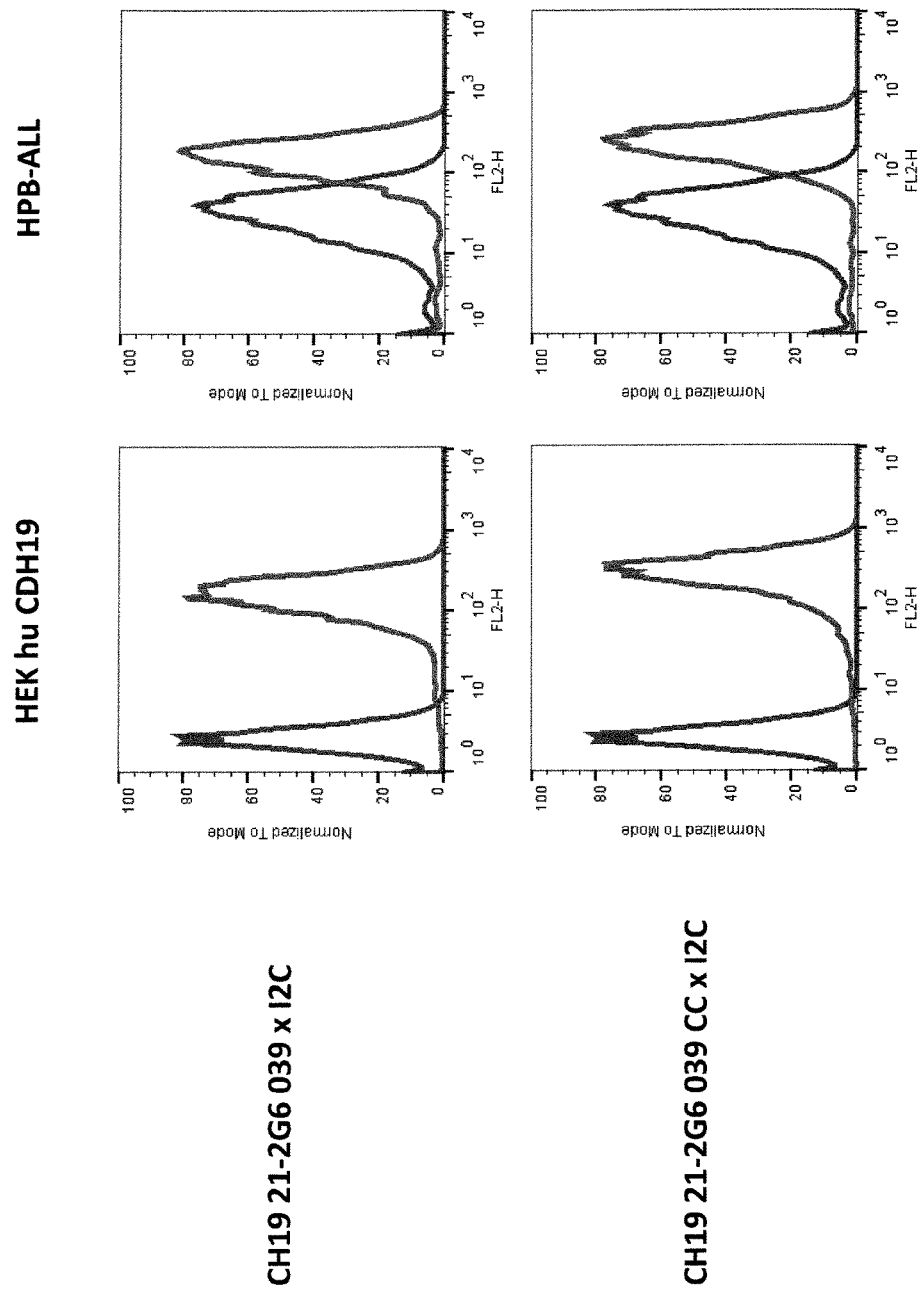
Figure 19:
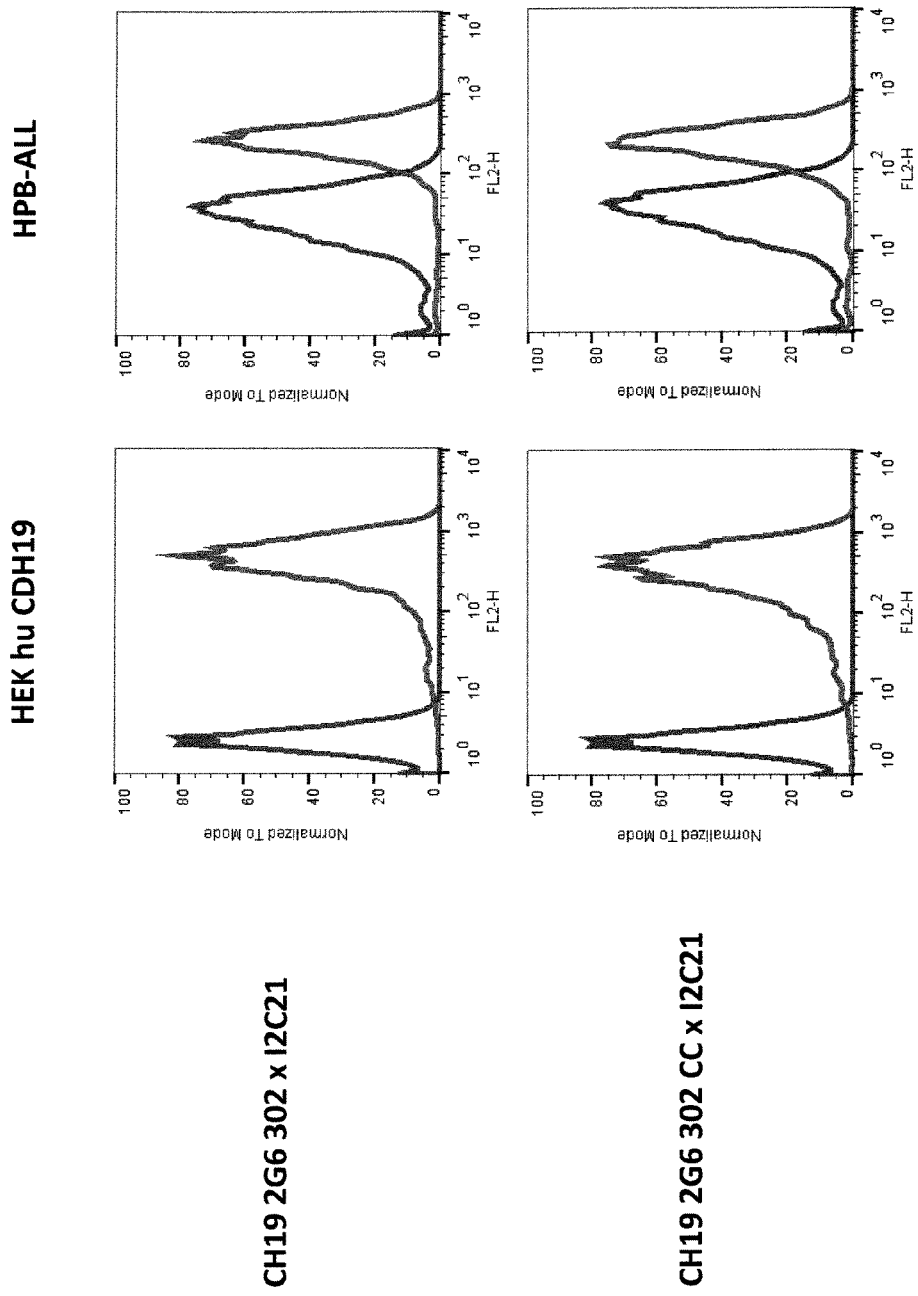
Figure 19:
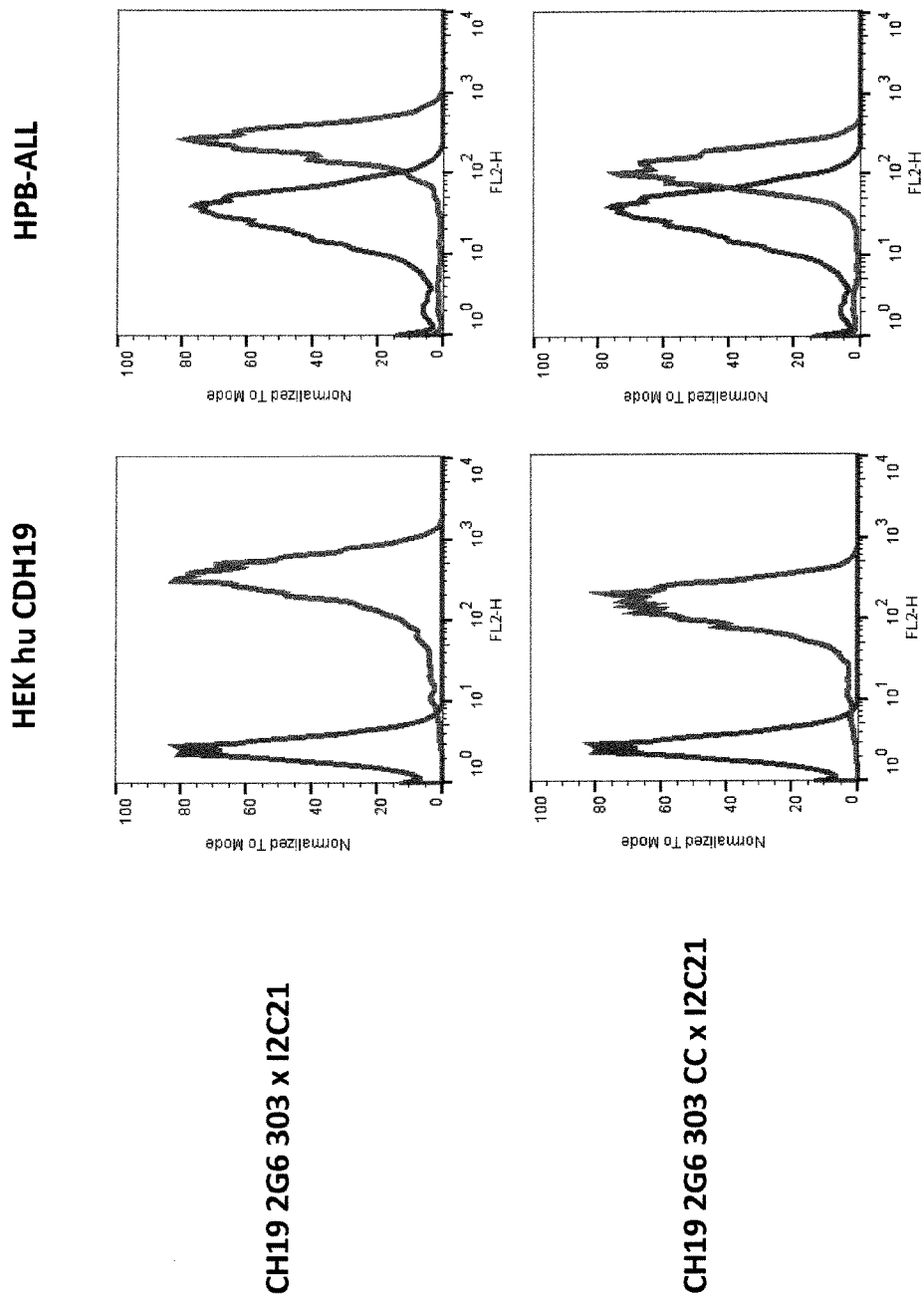
Figure 19:
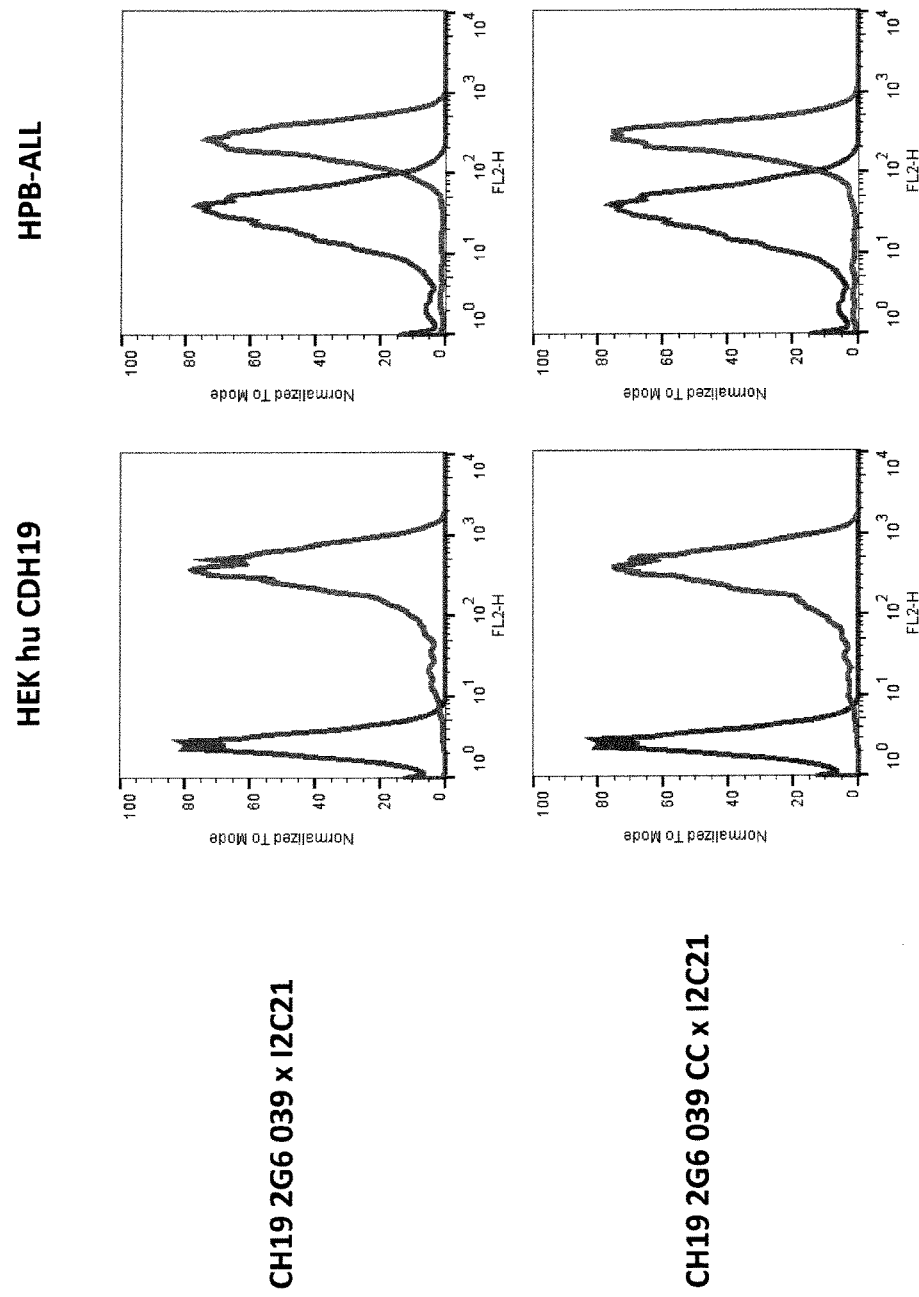
Figure 19:
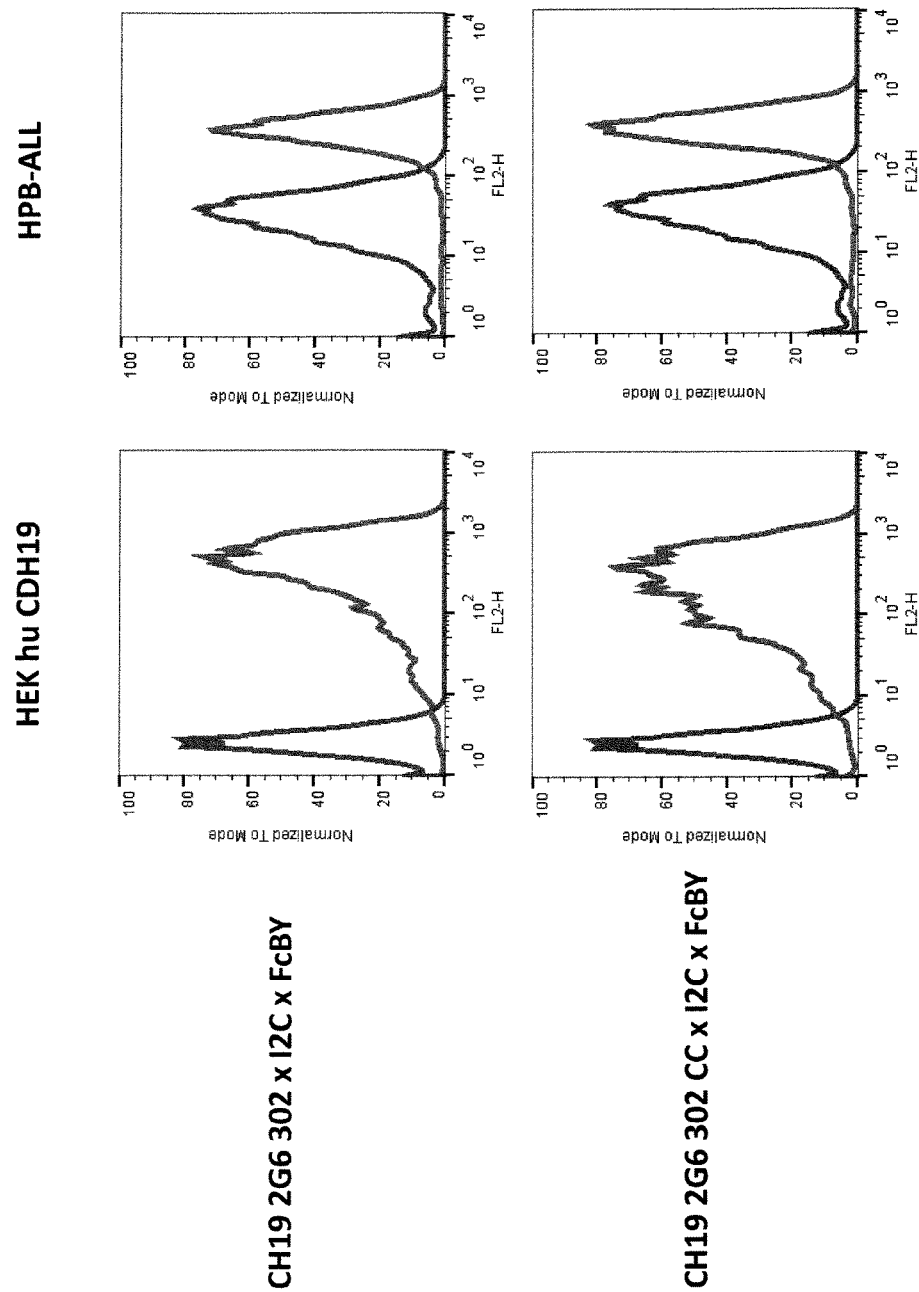
Figure 19:
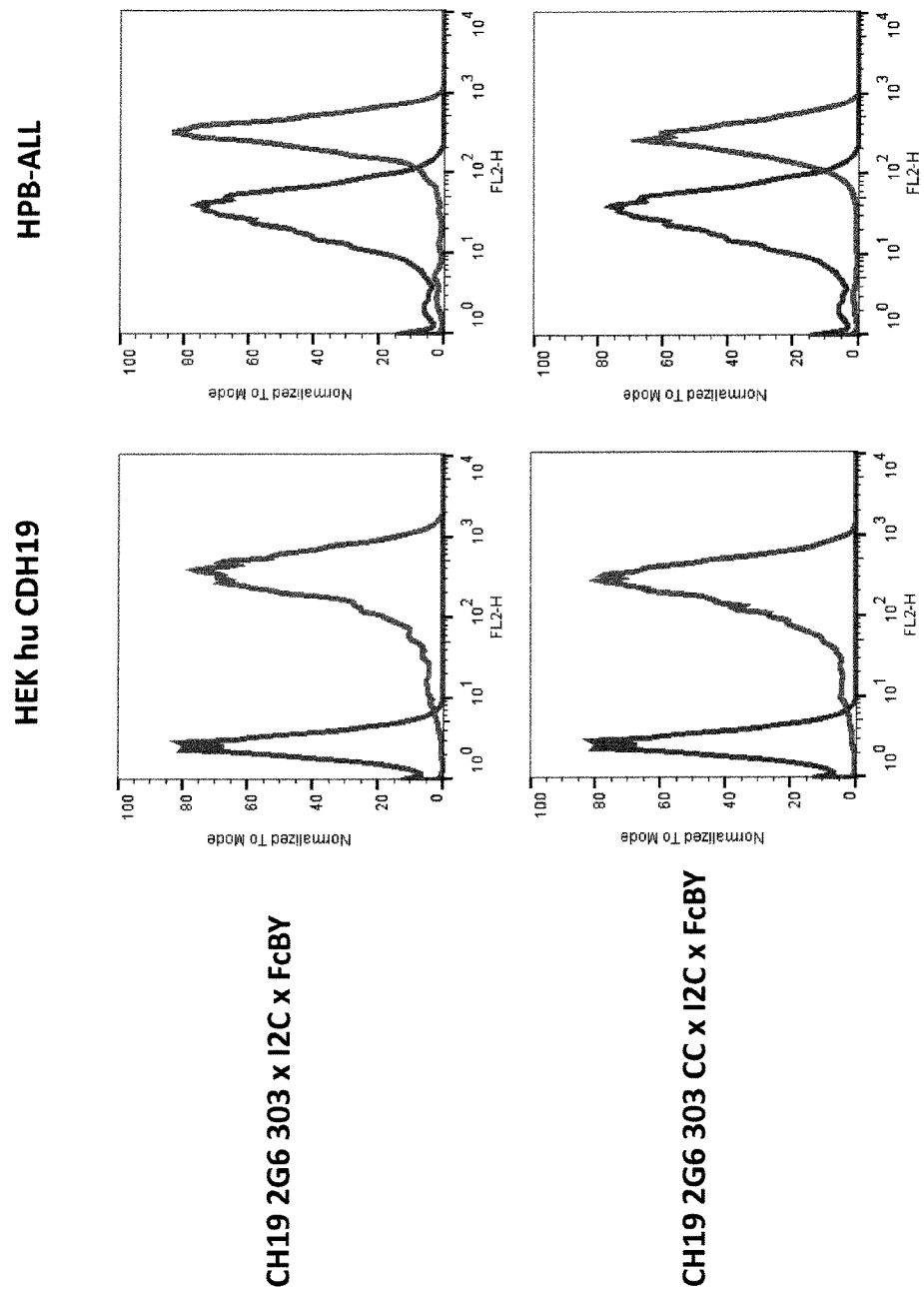
Figure 19:
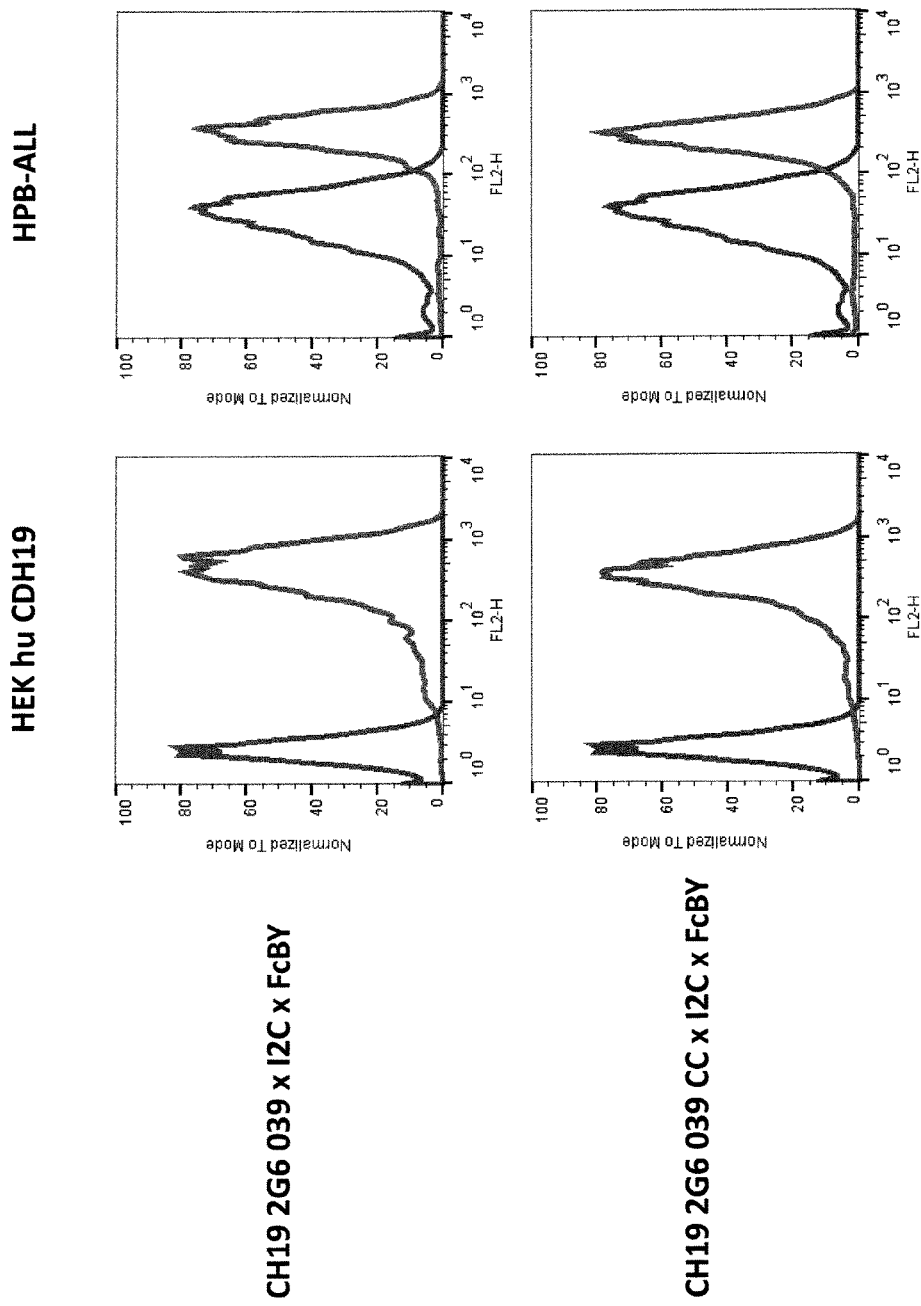

The CDH19/CD3 bispecific antibodies stained HEK293 cells transfected with human CDH19 as well as human and macaque T cells (see FIG. 19).

Example 14

Cytotoxic Activity
Chromium release assay with stimulated human T cells
Isolation of Effector Cells A petri dish (145 mm diameter, Greiner bio-one GmbH, Kremsmünster) was coated with a commercially available anti-CD3 specific antibody (OKT3, Orthoclone) in a final concentration of 1 µg/ml for 1 hour at 37° C. Unbound protein was removed by one washing step with PBS. 3-5× 10$^7$ human PBMC were added to the precoated petri dish in 120 ml of RPMI 1640 with stabilized glutamine/10% FCS/IL-2 20 U/ml (Proleukin®, Chiron) and stimulated for 2 days. On the third day, the cells were collected and washed once with RPMI 1640. IL-2 was added to a final concentration of 20 U/ml and the cells were cultured again for one day in the same cell culture medium as above.

Depletion of CD4$^+$ and CD56$^+$ Cells

CD8$^+$ cytotoxic T lymphocytes (CTLs) were enriched by depletion of CD4$^+$ T cells and CD56$^+$ NK cells using Dynal-Beads according to the manufacturer's protocol.

$^{51}$Cr Release Based Analysis

Figure 20:
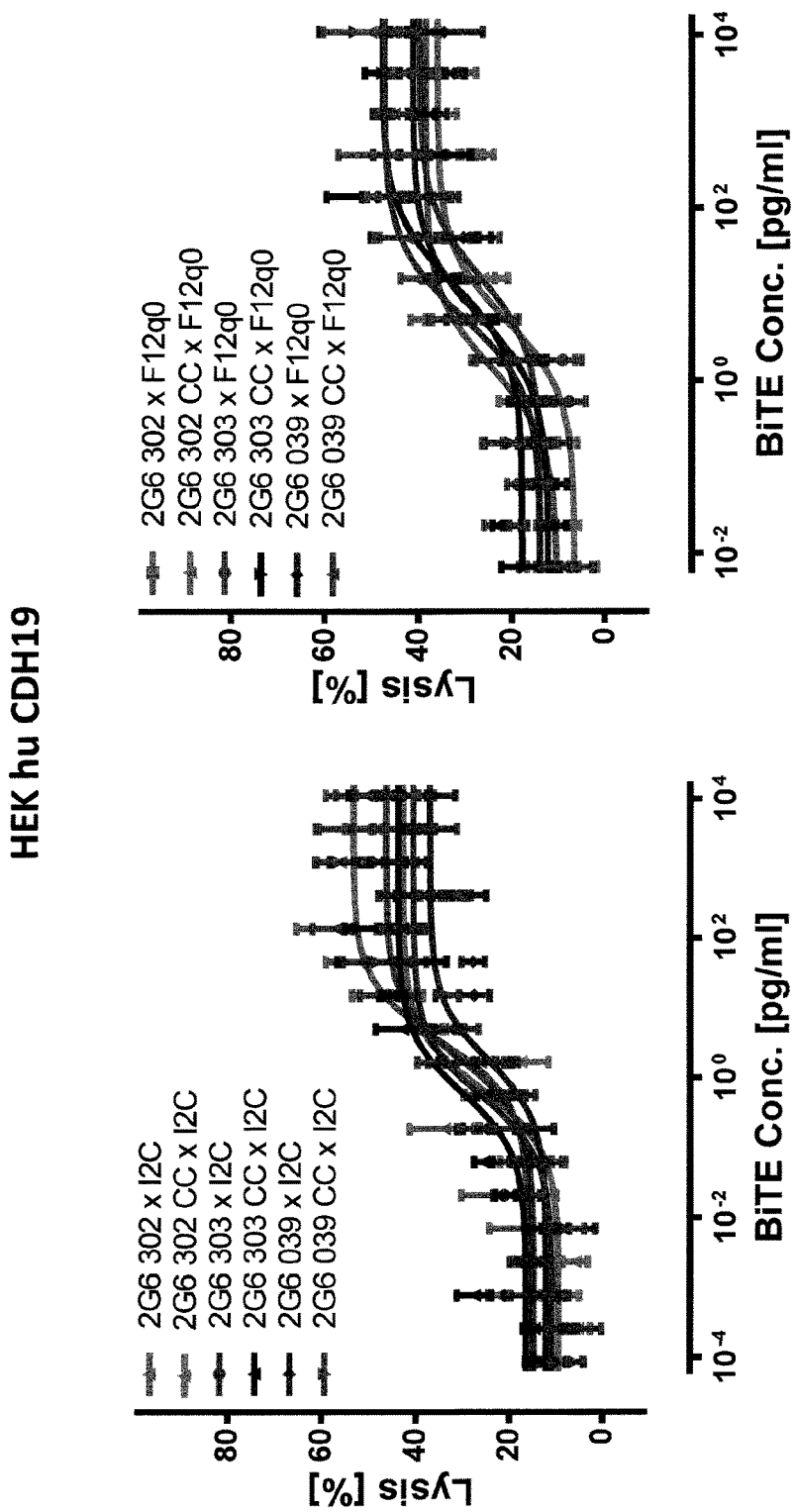
FIG. 20 Cytotoxic activity of CDH19/CD3 bispecific antibodies as measured in an 18-hour Chromium release-based cytotoxicity assay. Effector cells: stimulated human CD8+ T-cells. Target cells: HEK293 transfected with human CDH19. Effector to target cell (E:T)-ratio: 10:1.
Figure 20:
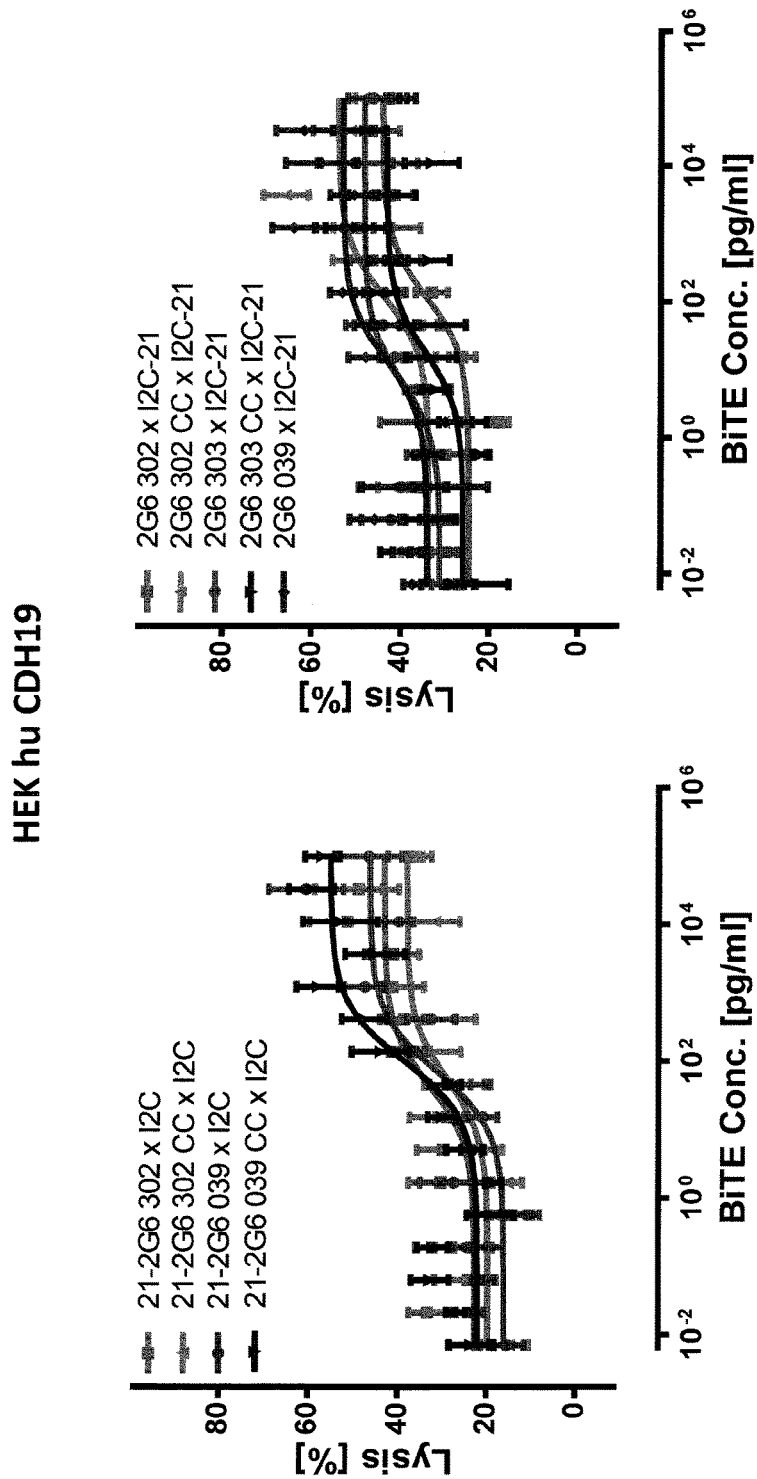

Human CDH19-transfected HEK293 target cells (production see example 14) were washed twice with PBS and labeled with 11.1 MBq $^{51}$Cr in a final volume of 50 µl supplemented RPMI for 60 minutes at 37° C. Subsequently, the labeled target cells were washed 3 times with 5 ml RPMI and then used in the cytotoxicity assay. The assay was performed in a 96-well plate in a total volume of 200 µl supplemented RPMI with an E:T ratio of 10:1. A starting concentration of 0.1-1 µg/ml of purified bispecific antibody and threefold dilutions thereof were used. Incubation time for the assay was 18 hours. Cytotoxicity was determined as relative values of released chromium in the supernatant relative to the difference of maximum lysis (addition of Triton-X) and spontaneous lysis (without effector cells). All measurements were carried out in quadruplicates. Measurement of chromium activity in the supernatants was performed in a Wizard 3" gamma counter (Perkin Elmer Life Sciences GmbH, Köln, Germany). Analysis of the results was carried out with Prism 6 for Windows (version 6.02, GraphPad Software Inc., San Diego, Calif., USA). EC50 values calculated by the analysis program from the sigmoidal dose response curves were used for comparison of cytotoxic activity (see FIG. 20).

Example 15

Production and Purification of BITE Antibodies

Standardized research scale production of CDH19 BiTE antibodies was performed in roller bottles. Harvested culture supernatant was subjected after filtration to two step BiTE antibody purification based either on immobilized metal affinity chromatography (IMAC) capture and subsequent size exclusion chromatography or Protein_A capture and subsequent size exclusion chromatography (SEC).

15.1 IMAC Capture Step of BiTE Antibodies

Figure 11:
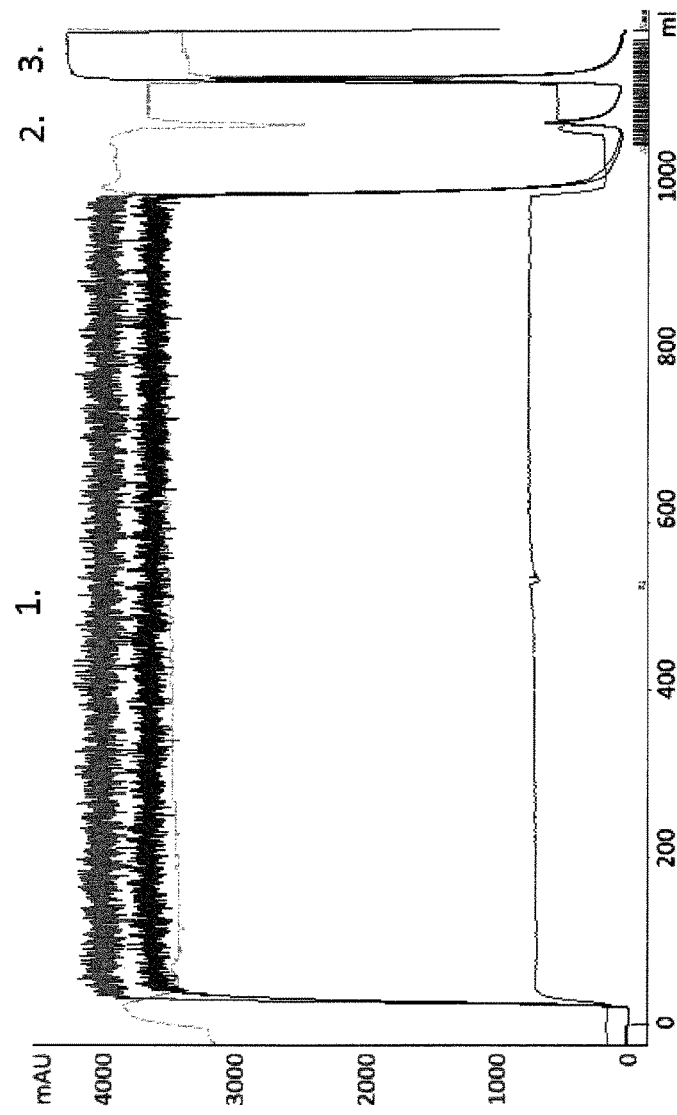
FIG. 11 Chromatogram IMAC capture and elution CH19 2G6 302×I2C SA21 Typical IMAC elution profile obtained during purification of an CDH19 BiTE antibody. The red line indicates absorption at 254 nm, the blue line indicates absorption at 280 nm. Brown line indicates conductivity. 1—Capture. 2—Pre-Elution 50 mM Imidazole. 3. BiTE Elution 500 mM Imidazole FIG. 12 Chromatogram Protein_A capture and elution CH19 2G6 302×F12Q Typical Protein_A elution profile obtained during purification of an CDH19 BiTE antibody. The red line indicates absorption at 254 nm, the blue line indicates absorption at 280 nm. Brown line indicates conductivity. Green line indicates the applied gradient percentage. 1—Capture. 2—BiTE Elution FIG. 13 SEC elution profile of CDH19 BiTE antibody 2G6 302×I2C SA21 Typical SEC elution profile obtained during purification of an CDH19 BiTE antibody. Protein peaks corresponding to the monomeric and dimeric BiTE antibody isoforms are indicated. LMW=low molecular weight. The red line indicates absorption at 254 nm, the blue line indicates absorption at 280 nm. Brown line indicates conductivity. 1—non BiTE aggregates in SEC exclusion volume. 2. BiTE dimer. 3. BiTE monomer. 4. Low molecular weight contaminants and salts FIG. 14 Reduced SDS PAGE analytics of CDH19 BiTE Monomer CH19 2G6 302×I2C SA21 (left) and molecular weight marker Novex Sharp Protein Standard (Life Technologies).

Äkta® Explorer Systems (GE Healthcare) controlled by Unicorn® Software were used for chromatography. Immobilized metal affinity chromatography (IMAC) was performed using Fractogel EMD Chelate® (Merck, Darmstadt) which was loaded with ZnCl2 according to the protocol provided by the manufacturer. The column was equilibrated with buffer A (20 mM sodium phosphate buffer, 0.1 M NaCl, 10 mM imidazole, pH 7.2) and the cell culture supernatant (1000 ml) applied to the column (10 ml packing volume) at a flow rate of 4 ml/min. The column was washed with buffer A to remove unbound sample. Bound protein was eluted using a two step gradient of buffer B (20 mM sodium phosphate buffer, 0.1 M NaCl, 0.5 M imidazole, pH 7.2) according to the following procedure: Step 1: 10% buffer B in 5 column volumes Step 2: 100% buffer B in 5 column volumes Eluted protein fractions from step 2 were pooled for further purification and concentrated to 3 ml final volume using Vivaspin (Sartorius-Stedim, Göttingen-Germany) centrifugation units with PES membrane and a molecular weight cut-off of 10 kDa. All chemicals were of research grade and purchased from Merck (Darmstadt, Germany). FIG. 11

15.2 Protein_A Capture of BiTE Antibodies

Äkta® Explorer Systems (GE Life Sciences) controlled by Unicorn® Software were used for chromatography. Affinity columns which containing beads with covalently bound Protein_A were used for the capture step. The column was equilibrated with equillibration buffer pH 7.4 and the cell culture supernatant applied. After washing the column with three column volumes of equillibration buffer to wash out unbound sample the bound BITE antibodies were eluted by application of an elution buffer at pH 3.0. Eluted solution was immediately neutralized in pH by a Trishydroxymethylamine Tris solution pH 8.0 already contained in the fractionation tubes in the fraction collector.

Figure 12:
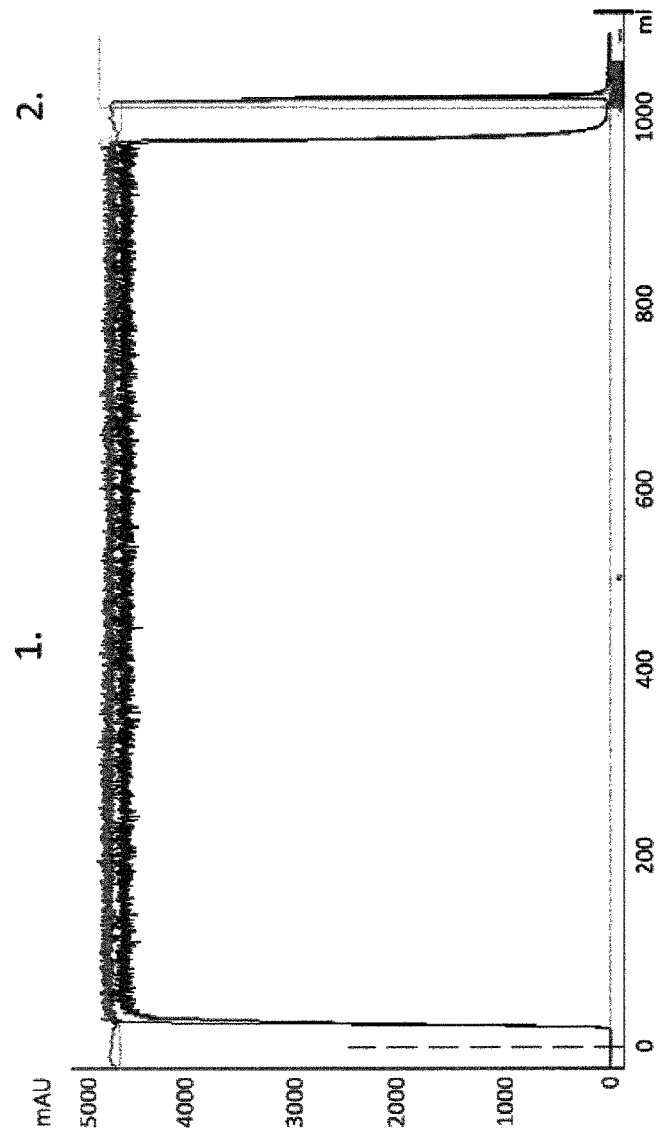

Eluted protein fractions from step 2 were pooled for further purification and concentrated to 3 ml final volume using Vivaspin (Sartorius-Stedim, Göttingen-Germany) centrifugation units with PES membran and a molecular weight cut-off of 10 kDa. All chemicals were of research grade and purchased from Merck (Darmstadt, Germany). FIG. 12

15.3 Size Exclusion Chromatography

Size exclusion chromatography was performed on a HiLoad 16/60 Superdex 200 prep grade column (GE Healthcare) equilibrated with SEC buffer (20 mM NaCl, 30 mM NaH2PO4, 100 mM L-Arginin, pH 7.0) at a flow rate of 1 ml/min. BiTE antibody monomer and dimer fractions were pooled and a 24% trehalose stock solution was added to reach a final trehalose concentration of 4%. Eluted protein samples were subjected to reducing SDS-PAGE and Anti His TAG Western Blot for analysis.

Protein pools were measured at 280 nm in polycarbonate cuvettes with 1 cm lightpath (Eppendorf, Hamburg-Germany) and protein concentration was calculated on the base of the Vector NTI sequence analysis software calculated factor for each protein.

BiTE monomer pools were adjusted to 250 µg/ml with additional BiTE formulation buffer (20 mM NaCl, 30 mM NaH2PO4, 100 mM L-Arginin, 4% Trehalose, pH 7.0). An amount of a minimum of 600 µg for each BiTE was taken and transferred for immediate protein analytics as described in example 16.

Remaining protein pools of BiTE antibody monomer and BiTE antibody dimer were aliquoted in 15 and 50 µg protein aliquots and shock frozen in liquid nitrogen. Further storage until usage was done in a −80° C. freezer until analysis of biologic activity and affinity measurements. FIG. 13.

The purity of isolated BiTE antibody monomer was determined by SDS-PAGE to be >95%. As expected, purified monomeric BiTE antibody appeared as protein bands in the molecular weight range of 54-56 kDa. FIG. 14

Example 16

Protein Properties

The freshly prepared BiTE monomer solution generated in example 15 was applied to the following analytical methods High Performance Size Exclusion Chromatography (HP-SEC) of initially monomeric CDH19 BiTE antibodies after one week of incubation at 250 µg/ml and 37° C.

BiTE monomer conversion of BiTE monomer to dimer by three freeze/thaw cycles followed by HP-SEC High resolution analytical cation exchange Hydrophobic interaction chromatography on a Sepharose Octyl FF matrix.

Concentration to 2500 µg/ml followed by overnight storage and turbidity measurement Aggregation temperature TA determination by heated Dynamic Light Scattering measurement 16.1 BITE Monomer Conversion into Dimer by Incubation for 7 Days 15 µg of the monomeric CDH19 BiTE antibody at a concentration of 250 µg/ml were incubated at 37° C. for 7 days.

Figure 15:
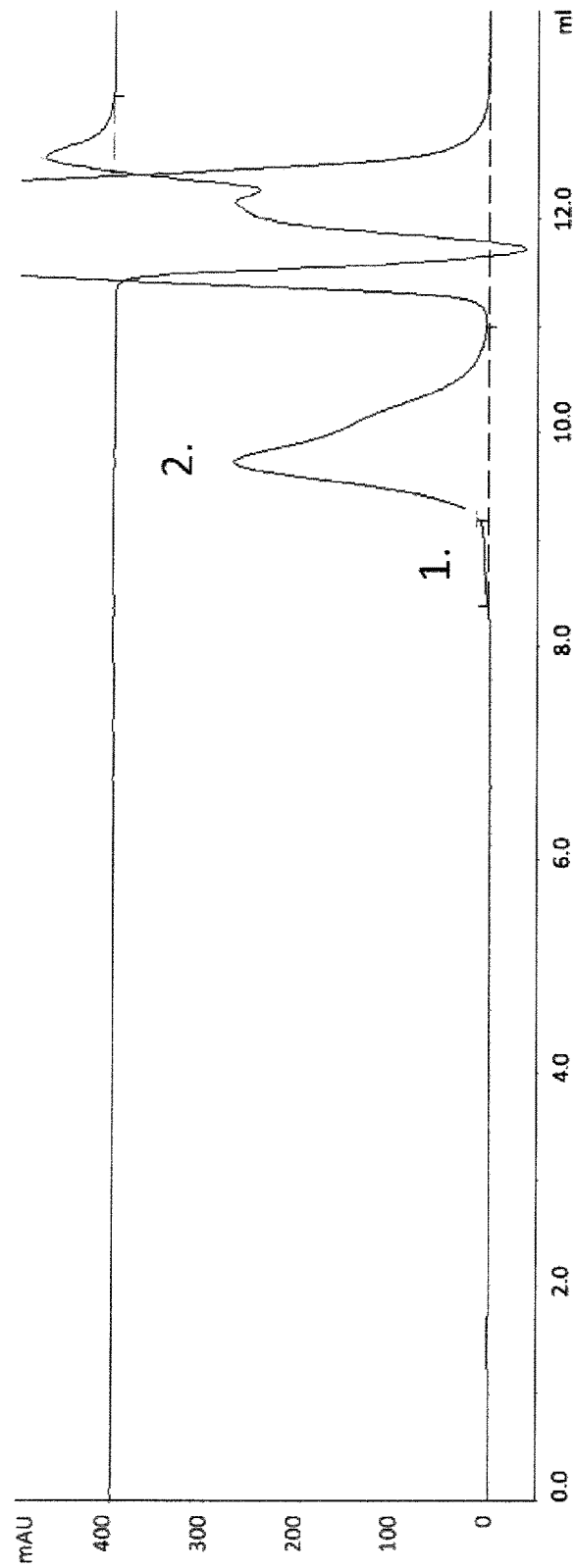
FIG. 15 HP-SEC chromatogram showing the elution of CDH19 BiTE CH19 2G6 302×I2C SA21 after seven day of storage at 37° C. Pink line indicating optical absorption at 210 nm wavelength. Brown line indicating conductivity. 1 BiTE Dimer. 2. BiTE Monomer FIG. 16 HP-SEC chromatogram showing the elution of CDH19 BITE CH19 2G6 302×I2C SA21 after three freeze/thaw cycles. Pink line indicating optical absorption at 210 nm wavelength. Brown line indicating conductivity. 1. BITE Monomer FIG. 17 CatIEX chromatogram of elution of CDH19 BITE CH19 2G6 302×I2C SA21. Blue line indicating optical absorption at 280 nm. Red line indicating optical absorption at 254 nm.

A high resolution SEC Column TSK Gel G3000 SWXL (Tosoh,Tokyo-Japan) was connected to an Äkta Purifier 10 FPLC (GE Lifesciences) equipped with an A905 Autosampler. Column equilibration and running buffer consisted of 100 mM KH2PO4-200 mM Na2SO4 adjusted to pH 6.6. After 7 days of incubation, the BiTE antibody solution (15 µg protein) was applied to the equilibrated column and elution was carried out at a flow rate of 0.75 ml/min at a maximum pressure of 7 MPa. The whole run was monitored at 280, 254 and 210 nm optical absorbance. Analysis was done by peak integration of the 210 nm signal recorded in the Äkta Unicorn software run evaluation sheet. Dimer content was calculated by dividing the area of the dimer peak by the total area of monomer plus dimer peak. FIG. 15

16.2. BiTE Monomer Conversion into Dimer by Three Freeze/Thaw Cycles

Figure 16:
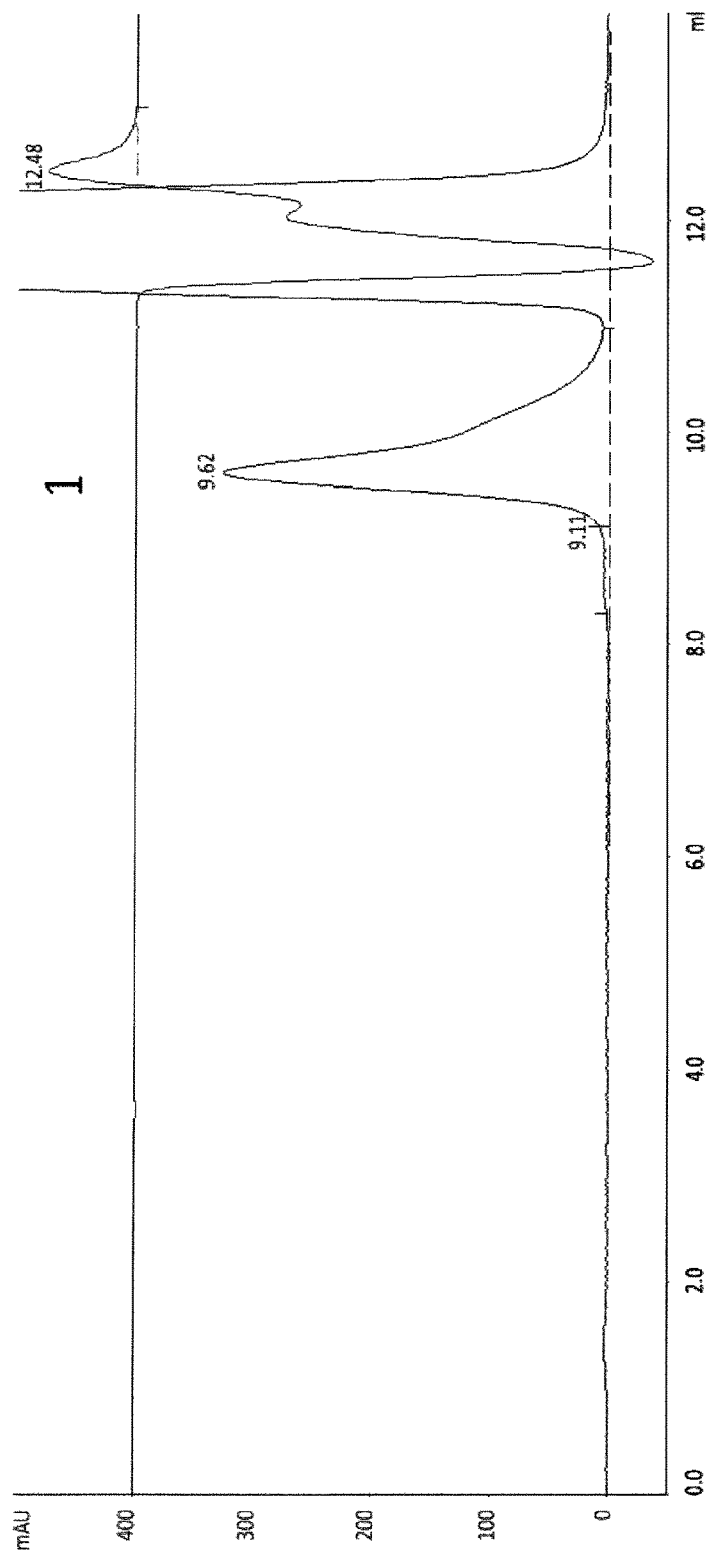

15 µg of monomeric BiTE antibody at 250 µg/ml were frozen at −80° C. for 30 min followed by thawing for 30 min at room temperature. After three freeze/thaw cycles the dimer content was determined by HP-SEC as described in example 16.1. FIG. 16 CDH19 BiTE CH19 2G6 302×I2C SA21: 0.50% Dimer content 16.3 High Resolution Analytical Ion Exchange Chromatography A 1 ml BioPro SP column manufactured by YMC (YMC Europe GmbH, Dinslaken-Germany) with sulphpropyl groups coupled to solid beads was connected to a Äkta Micro FPLC (GE Healthcare) device.

For column equilibration, sample dilution and washing a buffer consisting of 20 mM sodium dihydrogen phosphate and 30 mM sodium chloride adjusted with sodium hydroxide to a pH of 5.5 was used.

For elution a buffer consisting of 20 mM NaH2PO4 and 1000 mM NaCl adjusted with sodium hydroxide to a pH of 5.5 was used.

50 µg of BITE antibody monomer were diluted with dilution buffer to 50 ml final volume.

After column equilibration 40 ml of the diluted protein solution was applied to the column followed by a wash step.

Elution was carried out by a steadily increasing gradient with elution buffer from zero to 100% over a total volume corresponding to 200 column volumes. The whole run was monitored at 280 (blue line) and 254 nm (red line) optical absorption.

Figure 17:
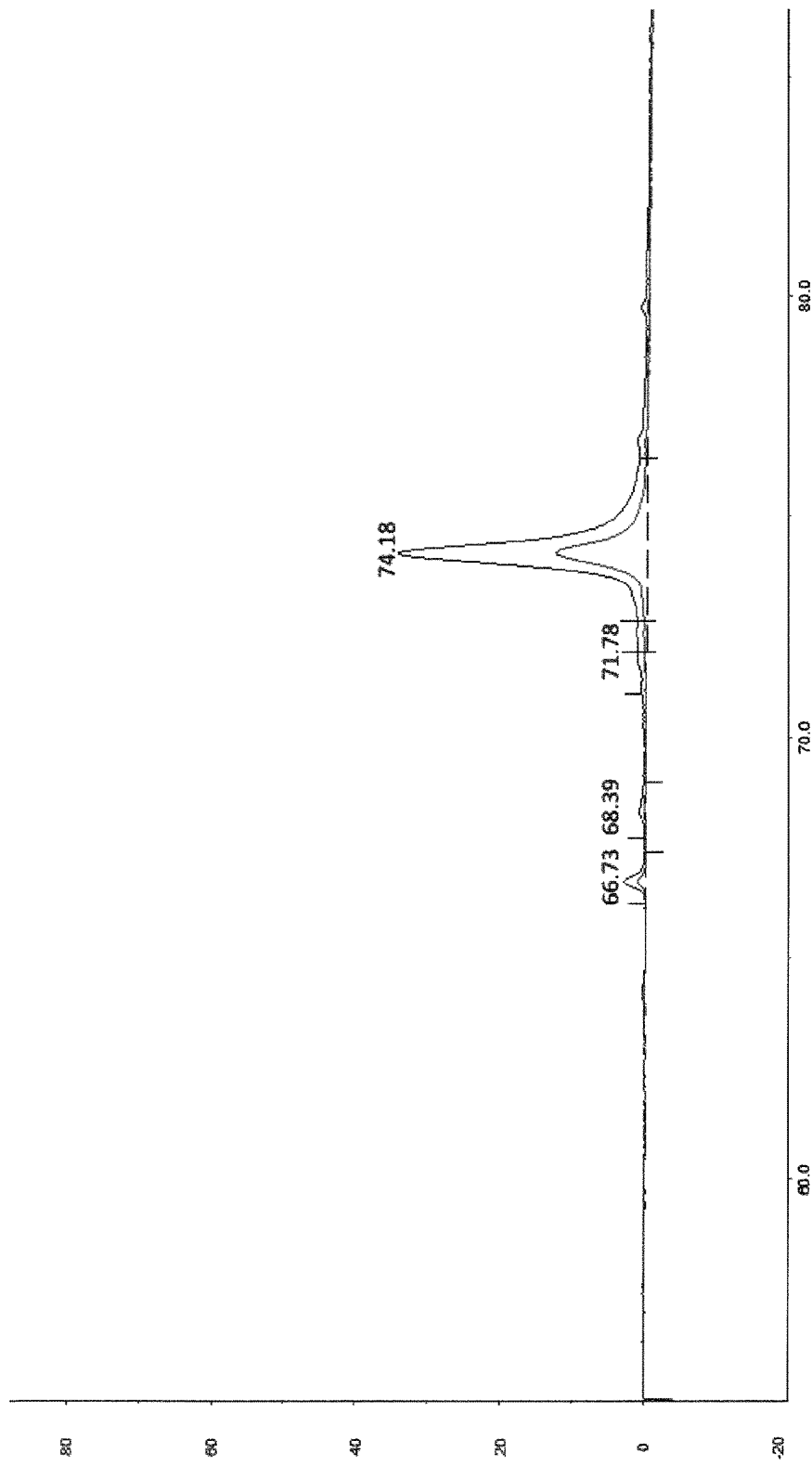

Percentage of Main Peak was calculated by dividing the peak area of the main peak by the sum of peak area of all detected peaks followed by multiplication with a factor of 100. FIG. 17

CDH19 BiTE CH19 2G6 302×I2C SA21: 89.3% Main Peak Percentage

16.4 Sepharose Octyl FF

Elution of monomeric BiTE antibodies was evaluated on a hydrophobic interaction chromatography C8 Sepharose Octyl FF column (GE Healthcare) with 1 ml gel volume. 50 µg of BiTE antibody monomeric protein was filled up with buffer (10 mM Citric acid–75 mM Lysine×HCl–4% Trehalose–pH 7.2) to a final volume of 300 µl. The column was connected to an Äkta Purifier 10 system (GE Healthcare). A 500 µl sample loop was connected to the system. The system and column were equilibrated with running buffer (10 mM Citric acid–75 mM Lysine×HCl–200 mM NaCl–pH 7.2).

Figure 18:
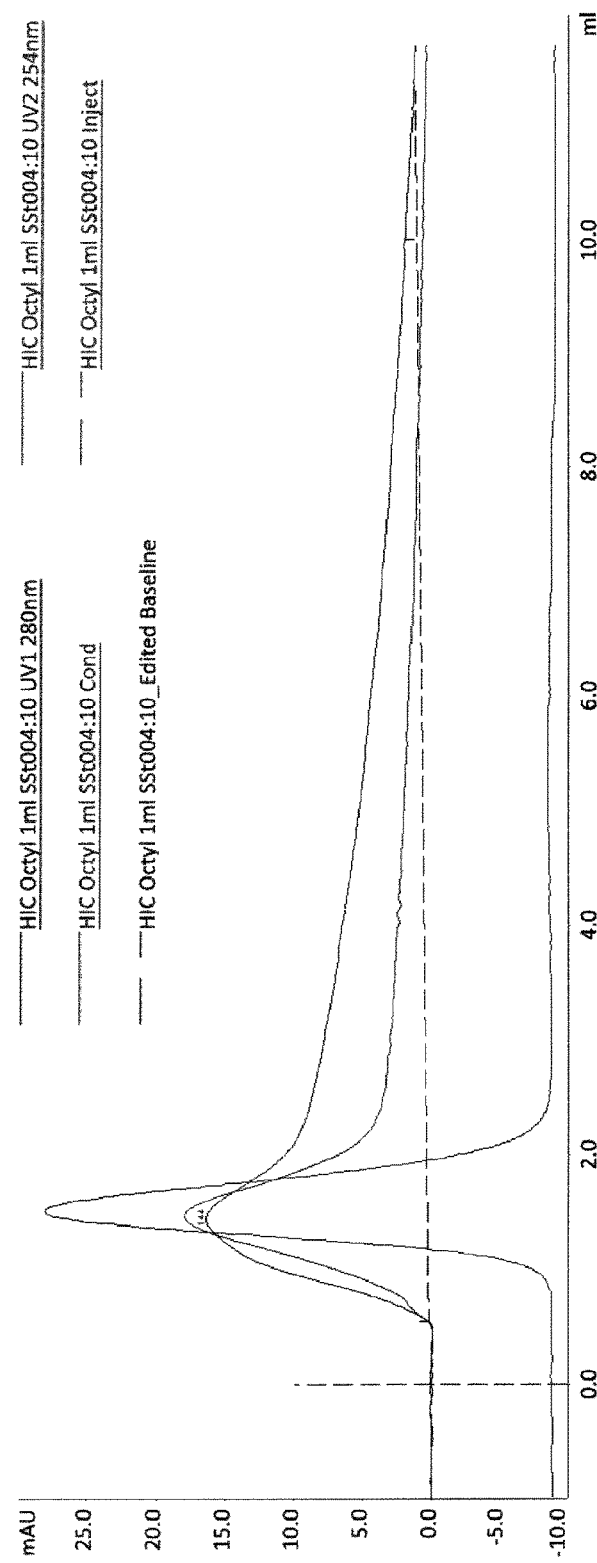
FIG. 18 HIC elution profile of CDH19 BiTE CH19 2G6 302×I2C SA21. Blue line indicating optical absorption at 280 nm. Red line indicating optical absorption at 254 nm. Brown line indicating conductivity.

The complete sample was injected into the sample loop and the content of the sample loop was applied to the column. After sample injection a volume of 10 ml running buffer was applied to the column at a flow rate of 0.2 ml/min while recording the optical absorption at 254 and 280 nm together with conductivity. FIG. 18 CDH19 BiTE CH19 2G6 302×I2C SA21: Rapid and complete elution

16.5 Concentration of BiTE Monomer to 2500 µg/ml Followed by Over Night Storage and Turbidity Measurement 1000 µl of CDH19 BiTE monomer were concentrated in two Vivaspin 500 centrifugation units with 10 kDa PES membran (Sartorius-Stedim, Göttingen-Germany) to a final volume of 100 µl. This volume as stored over night at 5° C. in a cooling cabinet. Turbidity was measured three times at 340 nm optical wavelength absorption. Afterwards the mean value of the three measurement values was calculated.

OD340 Turbidity of CDH19 BiTE CH19 2G6 302×I2C SA21: 0.034

16.6 Aggregation Temperature TA Determination by Heated Dynamic Light Scattering Measurement A volume of 40 µl monomeric BiTE antibody at 250 µg/ml was transferred into the inner core of a disposable plastic cuvette. The deeper placed outer core was filled up with generic BiTE formulation buffer. The top of the cuvette was sealed with a rubber top to avoid liquid loss by evaporation in the process of sample heating.

The cuvette was placed in a Nanostar Dynamic Light Scattering device (Wyatt) and heated from 40° C. to 70° C. at a heating increment of 0.5° C./min Aggregation status was permanently monitored and recorded in the whole heating process. Evaluation was executed with the software package supplied by the device manufacturer.

Aggregation temperature of CDH19 BiTE CH19 2G6 302×I2C SA21: 52.4° C.

16.7 PEGylation of BiTE Antibodies with CysLoop

Monomeric BiTE antibody containing an c-terminal CysLoop (see for methodical details WO 2006/008096) was dialyzed against a Tris/NaCl buffer pH 7.4 and reduced by the addition of the reduction agent Tris(2-carboxyethyl) phosphine TCEP (Perbio Pierce) to create two reduced cysteins of the now opened CysLoop.

TCEP was removed by dialysis. PEG Maleimid capable of covalent binding to reduced cystein was added in molar excess and incubated for 3 hours at room temperature. A Sepharose SP column cation exchange column (GE Healthcare) was connected to an Äkta FPLC system and equilibrated with binding buffer (low molar Phosphat/NaCl buffer of pH 5.0)

The protein solution was diluted with binding buffer adjusted to pH 5.0 to enable binding of the BiTE protein to the cation exchange column. Unbound PEG was removed in the wash step with further binding puffer pH 5.0 over 10 column volumes. Bound protein was eluted by a linear increasing percentage of elution buffer 20 mM phosphate 1 M NaCl.

PEGylated BiTE antibody eluted at lower molarity of the elutionbuffer compared to the unmodified BiTE antibody.

Sequence Table:

TABLE Ia

HEAVY CHAIN CDRs

| Ab | Type | CDR 1 | CDR 2 | CDR 3 |
|---|---|---|---|---|
| 1D10 2C12 | NA | AGCTATGGCATGCAC | GTTATATGGTATGATGGAAGT AATAAATACTATGCAGACTCC GTGAAGGGC | AGGGCCGGTATAATAGGAAC TACAGGCTACTACTACGGTA TGGACGTC |
|  |  | SEQ ID NO: 1 | SEQ ID NO: 2 | SEQ ID NO: 3 |
|  | AA | SYGMH | VIWYDGSNKYYADSVKG | RAGIIGTTGYYYGMDV |
|  |  | SEQ ID NO: 4 | SEQ ID NO: 5 | SEQ ID NO: 6 |
| 1F10 | NA | AGTGGTGGTTACTACT GGAGC | TACATCTATTACAGTGGGAGC ACCTACTACAACCCGTCCCTC ACGAGT | GATGGAAGCAGTGGCTGGTA CTTCCAGCAC |
|  |  | SEQ ID NO: 7 | SEQ ID NO: 8 | SEQ ID NO: 9 |
|  | AA | SGGYYWS | YIYYSGSTYYNPSLTS | DGSSGWYFQH |
|  |  | SEQ ID NO: 10 | SEQ ID NO: 11 | SEQ ID NO: 12 |
| 2C12_LC#1 | NA | AGCTATGGCATGCAC | GTTATATGGTATGATGGAAGT AATAAATACTATGCAGACTCC GTGAAGGGC | AGGGCCGGTATAATAGGAAC TACAGGCTACTACTACGGTA TGGACGTC |
|  |  | SEQ ID NO: 13 | SEQ ID NO: 14 | SEQ ID NO: 15 |
|  | AA | SYGMH | VIWYDGSNKYYADSVKG | RAGIIGTTGYYYGMDV |
|  |  | SEQ ID NO: 16 | SEQ ID NO: 17 | SEQ ID NO: 18 |
| 2G6_LC#1 | NA | AGCTATGGCATGCAC | TTTATATGGTATGATGGAAGT AATAAATACTATGCAGACTCC GTGAAGGAC | AGGGCCGGTATAATAGGAAC TATAGGCTACTACTACGGTA TGGACGTC |
|  |  | SEQ ID NO: 19 | SEQ ID NO: 20 | SEQ ID NO: 21 |
|  | AA | SYGMH | FIWYDGSNKYYADSVKD | RAGIIGTIGYYYGMDV |
|  |  | SEQ ID NO: 22 | SEQ ID NO: 23 | SEQ ID NO: 24 |

TABLE Ia-continued

HEAVY CHAIN CDRs

| Ab | Type | CDR 1 | CDR 2 | CDR 3 |
|---|---|---|---|---|
| 2G6 | NA | AGCTATGGCATGCAC | TTTATATGGTATGATGGAAGT AATAAATACTATGCAGACTCC GTGAAGGAC | AGGGCCGGTATAATAGGAAC TATAGGCTACTACTACGGTA TGGACGTC |
| | | SEQ ID NO: 25 | SEQ ID NO: 26 | SEQ ID NO: 27 |
| | AA | SYGMH | FIWYDGSNKYYADSVKD | RAGIIGTIGYYYGMDV |
| | | SEQ ID NO: 28 | SEQ ID NO: 29 | SEQ ID NO: 30 |
| 2H12 | NA | AGCTATGGCATGCAC | GTTATATGGTATGATGGAAGT AATAAATACTATACAGACTCC GTGAAGGGC | AGGGCCGGTATAATAGGAAC TACAGGCTACTACTACGGTA TGGACGTC |
| | | SEQ ID NO: 31 | SEQ ID NO: 32 | SEQ ID NO: 33 |
| | AA | SYGMH | VIWYDGSNKYYTDSVKG | RAGIIGTTGYYYGMDV |
| | | SEQ ID NO: 34 | SEQ ID NO: 35 | SEQ ID NO: 36 |
| 2H12_LC#2 | NA | AGCTATGGCATGCAC | GTTATATGGTATGATGGAAGT AATAAATACTATACAGACTCC GTGAAGGGC | AGGGCCGGTATAATAGGAAC TACAGGCTACTACTACGGTA TGGACGTC |
| | | SEQ ID NO: 37 | SEQ ID NO: 38 | SEQ ID NO: 39 |
| | AA | SYGMH | VIWYDGSNKYYTDSVKG | RAGIIGTTGYYYGMDV |
| | | SEQ ID NO: 40 | SEQ ID NO: 41 | SEQ ID NO: 42 |
| 4A2 5B4 5C5 | NA | AGTAGTGGTTACTACT GGAGC | TACATCTATTACACTGGGAGC GCCTACTACAACCCGTCCCTC AAGAGT | GATGGAAGCAGTGGCTGGTA CTTCCAGTAT |
| | | SEQ ID NO: 43 | SEQ ID NO: 44 | SEQ ID NO: 45 |
| | AA | SSGYYWS | YIYYTGSAYYNPSLKS | DGSSGWYFQY |
| | | SEQ ID NO: 46 | SEQ ID NO: 47 | SEQ ID NO: 48 |
| 4A9 | NA | GGTTACTACTGGAGC | TATTTCTCTTACAGTGGGAGC ACCAACTACAACCCCTCCCTC AAGAGT | AACTGGGCCTTCCACTTTGA CTTC |
| | | SEQ ID NO: 49 | SEQ ID NO: 50 | SEQ ID NO: 51 |
| | AA | GYYWS | YFSYSGSTNYNPSLKS | NWAFHFDF |
| | | SEQ ID NO: 52 | SEQ ID NO: 53 | SEQ ID NO: 54 |
| 4B10 4C2 | NA | AGCTATGACATGCAC | GTTATATCATATGATGGAACT AATGAATACTATGCAGACTCC GTGAAGGGC | GAACGATATTTTGACTGGTC TTTTGACTAC |
| | | SEQ ID NO: 55 | SEQ ID NO: 56 | SEQ ID NO: 57 |
| | AA | SYDMH | VISYDGTNEYYADSVKG | ERYFDWSFDY |
| | | SEQ ID NO: 58 | SEQ ID NO: 59 | SEQ ID NO: 60 |
| 4D2 | NA | AGTTATGACATGCAC | GTTATATCATATGATGGAACT AATGAATACTATGCAGACTCC GTGAAGGGC | GAACGATATTTTGACTGGTC TTTTGACTAC |
| | | SEQ ID NO: 61 | SEQ ID NO: 62 | SEQ ID NO: 63 |
| | AA | SYDMH | VISYDGTNEYYADSVKG | ERYFDWSFDY |
| | | SEQ ID NO: 64 | SEQ ID NO: 65 | SEQ ID NO: 66 |
| 4D3 4F3 | NA | AGCTATGACATGGAC | GTTATATGGTATGATGGAAGT AATAAAtacTATGCAGACTCC GTGAGGGGC | GAAACTGGGGAGGgCTGGTA CTTCGAtctc |
| | | SEQ ID NO: 67 | SEQ ID NO: 68 | SEQ ID NO: 69 |
| | AA | SYDMD | VIWYDGSNKYYADSVRG | ETGEGWYFDL |
| | | SEQ ID NO: 70 | SEQ ID NO: 71 | SEQ ID NO: 72 |
| 4E10 | NA | AGCTATGACATGCAC | GTTATATGGTATGATGGAAGT AATAAATACTATGCAGACTCC GTGAAGGGC | GAGTATAGGTACAGCTGGTA CTTTGACTAC |
| | | SEQ ID NO: 73 | SEQ ID NO: 74 | SEQ ID NO: 75 |
| | AA | SYDMH | VIWYDGSNKYYADSVKG | EYRYSWYFDY |
| | | SEQ ID NO: 76 | SEQ ID NO: 77 | SEQ ID NO: 78 |
| 4F7 | NA | AGTTACTCCTGGAGC | TATATCTATTACAGTGGGAGC ACCAACTACAACCCCTCCCTC AAGAGT | AACTGGGCCTTCCACTTTGA CTAC |
| | | SEQ ID NO: 79 | SEQ ID NO: 80 | SEQ ID NO: 81 |
| | AA | SYSWS | YIYYSGSTNYNPSLKS | NWAFHFDY |
| | | SEQ ID NO: 82 | SEQ ID NO: 83 | SEQ ID NO: 84 |
| 5E3 | NA | AGCTATAGCATGCAC | TCCATTAGTAGTAGTAGTAGT TACATATACTACGCAGACTCA GTGAAGGGC | GGGGAAACTGGAACTAACTA CTACTACTACGGTATGGACG TC |
| | | SEQ ID NO: 85 | SEQ ID NO: 86 | SEQ ID NO: 87 |
| | AA | SYSMH | SISSSSSYIYYADSVKG | GETGTNYYYYGMDV |
| | | SEQ ID NO: 88 | SEQ ID NO: 89 | SEQ ID NO: 90 |

TABLE Ia-continued

HEAVY CHAIN CDRs

| Ab | Type | CDR 1 | CDR 2 | CDR 3 |
|---|---|---|---|---|
| 17H8<br>23B6<br>28D10 | NA | AGTTACTACTGGAGC<br><br>SEQ ID NO: 91 | TATATCTATTACATTGGGAGC<br>ACCAACTACAACCCCTCCCTC<br>AAGAGT<br>SEQ ID NO: 92 | GATTCCCGGTATAGAAGTGG<br>CTGGTACGATGCTTTTGATA<br>TC<br>SEQ ID NO: 93 |
| | AA | SYYWS<br>SEQ ID NO: 94 | YIYYIGSTNYNPSLKS<br>SEQ ID NO: 95 | DSRYRSGWYDAFDI<br>SEQ ID NO: 96 |
| 16C1 | NA | GGTTACTACTGGAGC<br><br>SEQ ID NO: 97 | TATATCTATTACATTGGGAGC<br>ACCAACTACAACCCCTCCCTC<br>AAGAGT<br>SEQ ID NO: 98 | GATGGGAGCAGTGGCTGGTA<br>CCGGTGGTTCGACCCC<br><br>SEQ ID NO: 99 |
| | AA | GYYWS<br>SEQ ID NO: 100 | YIYYIGSTNYNPSLKS<br>SEQ ID NO: 101 | DGSSGWYRWFDP<br>SEQ ID NO: 102 |
| 16A4 | NA | AGTTACTACTGGAGC<br><br>SEQ ID NO: 103 | TATATCTATTACAGTGGGAGC<br>ACCAATTACAACCCCTCCCTC<br>AAGAGT<br>SEQ ID NO: 104 | GATCAAAGGCGGATAGCAGC<br>AGCTGGTACCCACTTCTACG<br>GTATGGACGTC<br>SEQ ID NO: 105 |
| | AA | SYYWS<br>SEQ ID NO: 106 | YIYYSGSTNYNPSLKS<br>SEQ ID NO: 107 | DQRRIAAAGTHFYGMDV<br>SEQ ID NO: 108 |
| 16E2<br>17E10<br>20B12 | NA | AGCTATGGCATGCAC<br><br>SEQ ID NO: 109 | GTGATATGGTATGATGGAAGT<br>AATAAATACTATGCAGACTCC<br>GTGAAGGGC<br>SEQ ID NO: 110 | GACGGGTGGGAGCTGTCCTT<br>TGACTAC<br><br>SEQ ID NO: 111 |
| | AA | SYGMH<br>SEQ ID NO: 112 | VIWYDGSNKYYADSVKG<br>SEQ ID NO: 113 | DGWELSFDY<br>SEQ ID NO: 114 |
| 22G10 | NA | AGTTATGCCATGAAC<br><br>SEQ ID NO: 115 | ACTATTAGTGGTGGTGGTGCT<br>AACACATACTACGCAGACTCC<br>GTGAAGGGC<br>SEQ ID NO: 116 | GGGGGAATGGGGGGATACTA<br>CTACGGTATGGACGTC<br><br>SEQ ID NO: 117 |
| | AA | SYAMN<br>SEQ ID NO: 118 | TISGGGANTYYADSVKG<br>SEQ ID NO: 119 | GGMGGYYYGMDV<br>SEQ ID NO: 120 |
| 16H2<br>20D3<br>23E7 | NA | AGCTACTTTATTCAC<br><br>SEQ ID NO: 121 | ATAATCAACCCTATTAGTGTT<br>AGCACAAGCTACGCACAGAAG<br>TTCCAGGGC<br>SEQ ID NO: 122 | GGGGGGATACAGCTATGGTT<br>ACATTTTGACTAC<br><br>SEQ ID NO: 123 |
| | AA | SYFIH<br>SEQ ID NO: 124 | IINPISVSTSYAQKFQG<br>SEQ ID NO: 125 | GGIQLWLHFDY<br>SEQ ID NO: 126 |
| 22D1 | NA | AGCTACTTTATTCAC<br><br>SEQ ID NO: 127 | ATAATCAACCCTATTAGTGTT<br>AGCACAAGCTACGCACAGAAG<br>TTCCAGGGC<br>SEQ ID NO: 128 | GGGGGGATACAGCTATGGTT<br>ACATTTGGACTAC<br><br>SEQ ID NO: 129 |
| | AA | SYFIH<br>SEQ ID NO: 130 | IINPISVSTSYAQKFQG<br>SEQ ID NO: 131 | GGIQLWLHLDY<br>SEQ ID NO: 132 |
| 25F8 | NA | AGCTACTATATTCAC<br><br>SEQ ID NO: 133 | ATAATCAACCCCAGTGGTGGT<br>AGCACAAGGTACGCACAGAAG<br>TTCCAGGGC<br>SEQ ID NO: 134 | GGGGGAATACAGCTATGGTT<br>ACATTttGACTAC<br><br>SEQ ID NO: 135 |
| | AA | SYYIH<br>SEQ ID NO: 136 | IINPSGGSTRYAQKFQG<br>SEQ ID NO: 137 | GGIQLWLHFDY<br>SEQ ID NO: 138 |
| 26F12<br>27B3 | NA | AACTACTATATGTCC<br><br>SEQ ID NO: 139 | ATAATCAACCCTAGTGGTGGT<br>GACTCAACCTACGCACAGAAG<br>TTCCAGGGC<br>SEQ ID NO: 140 | GGGGGGATACAACTATGGTT<br>ACATTTTGACTAC<br><br>SEQ ID NO: 141 |
| | AA | NYYMS<br>SEQ ID NO: 142 | IINPSGGDSTYAQKFQG<br>SEQ ID NO: 143 | GGIQLWLHFDY<br>SEQ ID NO: 144 |
| 26D1 | NA | AGCTACTATATGTCC<br><br>SEQ ID NO: 145 | ATAATCCACCCTAGTGGTGGT<br>GACACAACCTACGCACAGAAG<br>TTCCAGGGC<br>SEQ ID NO: 146 | GGGGGGATAAAACTATGGTT<br>ACATTTTGACTAT<br><br>SEQ ID NO: 147 |
| | AA | SYYMS<br>SEQ ID NO: 148 | IIHPSGGDTTYAQKFQG<br>SEQ ID NO: 149 | GGIKLWLHFDY<br>SEQ ID NO: 150 |
| 25G10 | NA | GGTTACTACTGGAGC<br><br>SEQ ID NO: 151 | TATATCTATTACATTGGGAGC<br>ACCAACTACAACCCCTCCCTC<br>AAGAGT<br>SEQ ID NO: 152 | GATGGGAGCAGTGGCTGGTA<br>CCGGTGGTTCGACCCC<br><br>SEQ ID NO: 153 |
| | AA | GYYWS<br>SEQ ID NO: 154 | YIYYIGSTNYNPSLKS<br>SEQ ID NO: 155 | DGSSGWYRWFDP<br>SEQ ID NO: 156 |

TABLE Ia-continued

HEAVY CHAIN CDRs

| Ab | Type | CDR 1 | CDR 2 | CDR 3 |
|---|---|---|---|---|
| 23A10 | NA | CGCTATGGCATACAC<br>SEQ ID NO: 157 | GTTATATGGTATGATGGAAGT<br>AATAAATACTATGCAGACTCC<br>GTGAAGGGC<br>SEQ ID NO: 158 | AGGGCCGGTATACCTGGAAC<br>TACGGGCTACTACTATGGTA<br>TGGACGTC<br>SEQ ID NO: 159 |
|  | AA | RYGIH<br>SEQ ID NO: 160 | VIWYDGSNKYYADSVKG<br>SEQ ID NO: 161 | RAGIPGTTGYYYGMDV<br>SEQ ID NO: 162 |
| 19B5 | NA | AGCTACTTTATTCAC<br>SEQ ID NO: 163 | ATTATCAACCCTATTAGTGTT<br>AGCACAAGCTACGCACAGAAG<br>TTCCAGGGC<br>SEQ ID NO: 164 | GGGGGGATACAGCTATGGTT<br>ACATTTGGACTAC<br>SEQ ID NO: 165 |
|  | AA | SYFIH<br>SEQ ID NO: 166 | IINPISVSTSYAQKFQG<br>SEQ ID NO: 167 | GGIQLWLHLDY<br>SEQ ID NO: 168 |

TABLE Ib

LIGHT CHAIN CDRs

| Ab | Type | CDR 1 | CDR 2 | CDR 3 |
|---|---|---|---|---|
| 1D10<br>2C12 | NA | TCTGGAGATAGATTGG<br>GGGAAAAATATACTTGC<br>SEQ ID NO: 169 | CAAGATACCAAGCGGCCCTCA<br>SEQ ID NO: 170 | CAGGCGTGGGACAGCAGCAC<br>TGTGGTA<br>SEQ ID NO: 171 |
|  | AA | SGDRLGEKYTC<br>SEQ ID NO: 172 | QDTKRPS<br>SEQ ID NO: 173 | QAWDSSTVV<br>SEQ ID NO: 174 |
| 1F10 | NA | AGGGCCAGTCGGAGTA<br>TTAGCAGCAGCTACTT<br>AGCC<br>SEQ ID NO: 175 | GGTCCATCCAGCAGGGCCACT<br>SEQ ID NO: 176 | CAGCAGTATGGTAGCTCATT<br>CACT<br>SEQ ID NO: 177 |
|  | AA | RASRSISSSYLA<br>SEQ ID NO: 178 | GPSSRAT<br>SEQ ID NO: 179 | QQYGSSFT<br>SEQ ID NO: 180 |
| 2C12_LC#1 | NA | AGGtCTAGTCAAAGcc<br>tcgtaTACAGTGATGG<br>AAACAcctACTTGAAT<br>SEQ ID NO: 181 | AAGGTTTCTAACTGGGactct<br>SEQ ID NO: 182 | ATGCAAGGTATAGTGTGGCC<br>GTGCAGT<br>SEQ ID NO: 183 |
|  | AA | RSSQSLVYSDGNTYLN<br>SEQ ID NO: 184 | KVSNWDS<br>SEQ ID NO: 185 | MQGIVWPCS<br>SEQ ID NO: 186 |
| 2G6_LC#1 | NA | AGGTCTAGTCAAAGCC<br>TCGTATACAGTGATGG<br>AAACACCTACTTGAAT<br>SEQ ID NO: 187 | CAGGTTTCTAACTGGGACTCT<br>SEQ ID NO: 188 | ATGCAAGATACACTGTGGCC<br>GTGCAGT<br>SEQ ID NO: 189 |
|  | AA | RSSQSLVYSDGNTYLN<br>SEQ ID NO: 190 | QVSNWDS<br>SEQ ID NO: 191 | MQDTLWPCS<br>SEQ ID NO: 192 |
| 2G6 | NA | TCTGGAGATAGGTTGG<br>GGGAAAAATATACTTGC<br>SEQ ID NO: 193 | CAAGATACCAAGCGGCCCTCA<br>SEQ ID NO: 194 | CAGGCGTGGGACAGCAGCAC<br>TGTGGTA<br>SEQ ID NO: 195 |
|  | AA | SGDRLGEKYTC<br>SEQ ID NO: 196 | QDTKRPS<br>SEQ ID NO: 197 | QAWDSSTVV<br>SEQ ID NO: 198 |
| 2H12 | NA | TCTGGAGATAGATTGG<br>GGGAAAAATATACTTGC<br>SEQ ID NO: 199 | CAAGATACCAAGCGGCCCTCA<br>SEQ ID NO: 200 | CAGGCGTGGGACAGCAGCAC<br>TGTGGTA<br>SEQ ID NO: 201 |
|  | AA | SGDRLGEKYTC<br>SEQ ID NO: 202 | QDTKRPS<br>SEQ ID NO: 203 | QAWDSSTVV<br>SEQ ID NO: 204 |
| 2H12_LC#2 | NA | AGGTCTAGTCAAAGCC<br>TCGTATACAGTGATGG<br>AAACACCTACTTGAAT<br>SEQ ID NO: 205 | AAGGTTTCTAACTGGGACTCT<br>SEQ ID NO: 206 | ATGCAAGATACACTGTGGCC<br>GTGCAGT<br>SEQ ID NO: 207 |
|  | AA | RSSQSLVYSDGNTYLN<br>SEQ ID NO: 208 | KVSNWDS<br>SEQ ID NO: 209 | MQDTLWPCS<br>SEQ ID NO: 210 |
| 4A2<br>5B4<br>5C5 | NA | AGGgcCAGTCGGAATA<br>TTAGCAGCAGCTACtt<br>aGCC<br>SEQ ID NO: 211 | GGTCCATCCAGCAGGGccaCT<br>SEQ ID NO: 212 | CAGCAGTATGGtagctCATT<br>CACT<br>SEQ ID NO: 213 |
|  | AA | RASRNISSSYLA<br>SEQ ID NO: 214 | GPSSRAT<br>SEQ ID NO: 215 | QQYGSSFT<br>SEQ ID NO: 216 |

TABLE Ib-continued

LIGHT CHAIN CDRs

| Ab | Type | CDR 1 | CDR 2 | CDR 3 |
|---|---|---|---|---|
| 4A9 | NA | ACTGGGAGCAGCTCCAACATCGGGACAGGTTATGCTGTACAC | GGTAACAACAATCGGCCCTCA | CAGTCCTATGACAGCagACTGAGTGGTTGGGTG |
| | | SEQ ID NO: 217 | SEQ ID NO: 218 | SEQ ID NO: 219 |
| | AA | TGSSSNIGTGYAVH | GNNNRPS | QSYDSRLSGWV |
| | | SEQ ID NO: 220 | SEQ ID NO: 221 | SEQ ID NO: 222 |
| 4B10 4C2 | NA | AGGGCCAGTCAGAGTGTTAGCAACACCTACTTAGCC | GGTGCATCCAGCAGGGCCACT | CAGCAGTACAGTAACTCgtgGACG |
| | | SEQ ID NO: 223 | SEQ ID NO: 224 | SEQ ID NO: 225 |
| | AA | RASQSVSNTYLA | GASSRAT | QQYSNSWT |
| | | SEQ ID NO: 226 | SEQ ID NO: 227 | SEQ ID NO: 228 |
| 4D2 | NA | AGGGCCAGTCAGAGTGTTAGCAACACCTACTTAGCC | GGTGCATCCAGCAGGGCCGCT | CagcagTATAGTAacTcgtgGACG |
| | | SEQ ID NO: 229 | SEQ ID NO: 230 | SEQ ID NO: 231 |
| | AA | RASQSVSNTYLA | GASSRAA | QQYSNSWT |
| | | SEQ ID NO: 232 | SEQ ID NO: 233 | SEQ ID NO: 234 |
| 4D3 4F3 | NA | AGGGCCAGTCAGAGTGTTAGCAGCAGCTACTTAGCC | GGTGCATCCAGCAGGGCCACT | CAGCAGTATGGTAGCTCGTGGACG |
| | | SEQ ID NO: 235 | SEQ ID NO: 236 | SEQ ID NO: 237 |
| | AA | RASQSVSSSYLA | GASSRAT | QQYGSSWT |
| | | SEQ ID NO: 238 | SEQ ID NO: 239 | SEQ ID NO: 240 |
| 4E10 | NA | AGGGCCAGTCAGAGTGTTGGCAGCAGCTACTTAGCC | GGTGCATCCAGCAGGGTCACT | CAGCAATATAGTAACTCGTGGACG |
| | | SEQ ID NO: 241 | SEQ ID NO: 242 | SEQ ID NO: 243 |
| | AA | RASQSVGSSYLA | GASSRVT | QQYSNSWT |
| | | SEQ ID NO: 244 | SEQ ID NO: 245 | SEQ ID NO: 246 |
| 4F7 | NA | ACTGGGAGCAGCTCCAATATCGGGACAGGTTATGATGTACAC | GGTAACAGCAATCGGCCCTCA | CAGTCCTATGACAGCAGTCTGAGTGGTTGGGTG |
| | | SEQ ID NO: 247 | SEQ ID NO: 248 | SEQ ID NO: 249 |
| | AA | TGSSSNIGTGYDVH | GNSNRPS | QSYDSSLSGWV |
| | | SEQ ID NO: 250 | SEQ ID NO: 251 | SEQ ID NO: 252 |
| 5E3 | NA | TCTGGAGATAAATTGGGGGATGAATATGCTTGC | CAAGATAGCAAGCGGCCCTCA | CAGGCGTGGGACAGCAGCACTGTGGTA |
| | | SEQ ID NO: 253 | SEQ ID NO: 254 | SEQ ID NO: 255 |
| | AA | SGDKLGDEYAC | QDSKRPS | QAWDSSTVV |
| | | SEQ ID NO: 256 | SEQ ID NO: 257 | SEQ ID NO: 258 |
| 17H8 23B6 28D10 | NA | AGGGCCAGTCAGAGTGTTGCCGGCAGCTACCTAGCC | GGTGCATCCAGCAGGGCCACT | CAGCAGTATGGTAAATCACCGATCACC |
| | | SEQ ID NO: 259 | SEQ ID NO: 260 | SEQ ID NO: 261 |
| | AA | RASQSVAGSYLA | GASSRAT | QQYGKSPIT |
| | | SEQ ID NO: 262 | SEQ ID NO: 263 | SEQ ID NO: 264 |
| 16C1 | NA | AGGGCCAGCCAGAGTGTTAGCAGCAGCTACTTAGCC | GGTGCATCCAGCAGGGCCACT | CAGCAGTATGGTAACTCACCGCTCACT |
| | | SEQ ID NO: 265 | SEQ ID NO: 266 | SEQ ID NO: 267 |
| | AA | RASQSVSSSYLA | GASSRAT | QQYGNSPLT |
| | | SEQ ID NO: 268 | SEQ ID NO: 269 | SEQ ID NO: 270 |
| 16A4 | NA | AGGGCCAGTCAGAGTGTTAGCAGCAGTTATTTAGCC | GGTACATCCAGCAGGGCCACT | CAGCAGTACGGTAGCTCACCTTTCACT |
| | | SEQ ID NO: 271 | SEQ ID NO: 272 | SEQ ID NO: 273 |
| | AA | RASQSVSSSYLA | GTSSRAT | QQYGSSPFT |
| | | SEQ ID NO: 274 | SEQ ID NO: 275 | SEQ ID NO: ***276 |
| 16E2 17E10 20B12 | NA | CGGGCGAGTCAGGGCATTAGCAATTATTTAGCC | GCTGCATCCAGTTTGCAAAGT | CAACACTATTTTACTTACCCTCGGACG |
| | | SEQ ID NO: 277 | SEQ ID NO: 278 | SEQ ID NO: 279 |
| | AA | RASQGISNYLA | AASSLQS | QHYFTYPRT |
| | | SEQ ID NO: 280 | SEQ ID NO: 281 | SEQ ID NO: 282 |

TABLE Ib-continued

| | | LIGHT CHAIN CDRs | | |
|---|---|---|---|---|
| Ab | Type | CDR 1 | CDR 2 | CDR 3 |
| 22G10 | NA | AGGGCCAGTCAGAGTA TTAGCAGCAACTTAGCC SEQ ID NO: 283 | GGTGCATTTACCAGGGCCACT SEQ ID NO: 284 | CAGCAGTATAATTACTGGCC GCTCACT SEQ ID NO: 285 |
| | AA | RASQSISSNLA SEQ ID NO: 286 | GAFTRAT SEQ ID NO: 287 | QQYNYWPLT SEQ ID NO: 288 |
| 16H2 20D3 23E7 | NA | TCTGGAAGCAGCTCCA ACATCGGAAGTAATTT TGTAAAC SEQ ID NO: 289 | ACTAATAATCAGCGGCCCTCA SEQ ID NO: 290 | GCAACATGGGATGACAGCCT GAATGGTTGGGTG SEQ ID NO: 291 |
| | AA | SGSSSNIGSNFVN SEQ ID NO: 292 | TNNQRPS SEQ ID NO: 293 | ATWDDSLNGWV SEQ ID NO: 294 |
| 22D1 | NA | TCTGGAAGCAGCTCCA ACATCGGAAGCAATTT TGTAAAC SEQ ID NO: 295 | ACTAATAATCAGCGGCCCTCA SEQ ID NO: 296 | GCAACATGGGATGACAGTAT GAATGGTTGGGTG SEQ ID NO: 297 |
| | AA | SGSSSNIGSNFVN SEQ ID NO: 298 | TNNQRPS SEQ ID NO: 299 | ATWDDSMNGWV SEQ ID NO: 300 |
| 25F8 | NA | TCTGGAAGCAGCTCCA ACATCGGAAGGAATTT TGTAAAC SEQ ID NO: 301 | ACTAATAATCAGCGGCCCTCA SEQ ID NO: 302 | GCAGCATGGGATGACAGCCT GAATGGTTGGGTG SEQ ID NO: 303 |
| | AA | SGSSSNIGRNFVN SEQ ID NO: 304 | TNNQRPS SEQ ID NO: 305 | AAWDDSLNGWV SEQ ID NO: 306 |
| 26F12 27B3 | NA | TCTGGAAGCCGCTCCA ACATCGGAAGTAATTT TGTAAAC SEQ ID NO: 307 | ACTAATTATCAGCGGCCCTCA SEQ ID NO: 308 | GCAGTATGGGATGACAGCCT GAATGGTTGGGTG SEQ ID NO: 309 |
| | AA | SGSRSNIGSNFVN SEQ ID NO: 310 | TNYQRPS SEQ ID NO: 311 | AVWDDSLNGWV SEQ ID NO: 312 |
| 26D1 | NA | TCTGGAAGCCGCTCCA ACATCGGAAGTAATTT TGTAAAC SEQ ID NO: 313 | ACTAATAATCAGCGGCCCTCA SEQ ID NO: 314 | GCAGTATGGGATGACAGCCT GAATGGTTGGGTG SEQ ID NO: 315 |
| | AA | SGSRSNIGSNFVN SEQ ID NO: 316 | TNNQRPS SEQ ID NO: 317 | AVWDDSLNGWV SEQ ID NO: 318 |
| 25G10 | NA | AGGGCCAGTCAGAGTG TTAGCAGCAGCTACTT AGCC SEQ ID NO: 319 | GGTGCATCCAGCAGGGCCACT SEQ ID NO: 320 | CAGCAGTATGGTAACTCACC GCTCACT SEQ ID NO: 321 |
| | AA | RASQSVSSSYLA SEQ ID NO: 322 | GASSRAT SEQ ID NO: 323 | QQYGNSPLT SEQ ID NO: 324 |
| 23A10 | NA | TCTGGAGATAGATTGG GGGAGAAATATGTTTGC SEQ ID NO: 325 | CAAGATAATAAGTGGCCCTCA SEQ ID NO: 326 | CAGGCGTGGGACAGCAGcac TGTGGTA SEQ ID NO: 327 |
| | AA | SGDRLGEKYVC SEQ ID NO: 328 | QDNKWPS SEQ ID NO: 329 | QAWDSSTVV SEQ ID NO: 330 |
| 19B5 | NA | TCTGGAAGCAGGTCCA ACATCGGAAGCAATTT TGTAAAC SEQ ID NO: 331 | ACTAATAATCAGCGGCCCTCA SEQ ID NO: 332 | GCAACATGGGATGACAGTAT GAATGGTTGGGTG SEQ ID NO: 333 |
| | AA | SGSRSNIGSNFVN SEQ ID NO: 334 | TNNQRPS SEQ ID NO: 335 | ATWDDSMNGWV SEQ ID NO: 336 |

Anti-CDH19 Variable Region Amino Acid Sequences and
Polynucleotide Sequences

TABLE IIa

Heavy Chain Variable Region Polynucleotide and Amino acid Sequences

| SEQ ID NO. | DESIGNATION | SOURCE | TYPE | SEQUENCE |
|---|---|---|---|---|
| 337 | 17H8 23B6 28D10 | artificial | nt | CAGGTGCAGCTGCAGGAGTCGGGCCCAGGACTGGTGAAGCCTTCGGAGACCCTGTCCCTCACGTGCACTGT CTCTGGTGGCTCCATCAATAGTTACTACTGGAGCTGGATCCGGCAGCCCCCAGGGAAGGGACTGGAGTGGA TTGGGTATATCTATTACATTGGGAGCACCAACTACAACCCCTCCCTCAAGAGTCGCGTCACCATATCAGTA GACACGTCCAAGAACCAGTTCTCCCTGAAGCTGAGCTCTGTGACCGCTGCGGACACGGCCCTGTATTACTG TGCGAGAGATTCCCGGTATAGAAGTGGCTGGTACGATGCTTTTGATATCTGGGGCCAAGGGACAATGGTCA CCGTCTCTTCA |
| 338 | 17H8 23B6 28D10 | artificial | aa | QVQLQESGPGLVKPSETLSLTCTVSGGSINSYYWSWIRQPPGKGLEWIGYIYYIGSTNYNPSLKSRVTISV DTSKNQFSLKLSSVTAADTALYYCARDSRYRSGWYDAFDIWGQGTMVTVSS |
| 339 | 4A2 5B4 5C5 | artificial | nt | CAGGTGCAGCTGCAGGAGTCGGGCCCAGGACTGGTGAAGCCTTCACAGACCCTGTCCCTCACCTGCACTGT CTCTGGTGGCTCCATCAGCAGTAGTGGTTACTACTGGAGCTGGATCCGCCAGCACCCAGGGAAGGGCCTGG AGTGGATTGGGTACATCTATTACACTGGGAGCGCCTACTACAACCCGTCCCTCAAGAGTCGAGTTACCATA TCAGTAGACACGTCTAAGAACCAGTTCTCCCTGAAGCTGAGCTCTGTGACTGCCGCGGACACGGCCGTGTA TTACTGTGCGAGAGATGGAAGCAGTGGCTGGTACTTCCAGTATTGGGGCCAGGGCACCCTGGTCACCGTCT CCTCA |
| 340 | 4A2 5B4 5C5 | artificial | aa | QVQLQESGPGLVKPSQTLSLTCTVSGGSISSSGYYWSWIRQHPGKGLEWIGYIYYTGSAYYNPSLKSRVTI SVDTSKNQFSLKLSSVTAADTAVYYCARDGSSGWYFQYWGQGTLVTVSS |
| 341 | 16H2 20D3 23E7 | artificial | nt | CAGGTGCAGCTGGTGCAGTCTGGGGCTGAGGTGAAGAAGCCTGGGGCCTCAGTGAAGGTTTCCTGCAAGGT TTCTGGATACACCTTCACCAGCTACTTTATTCACTGGGTGCGCCAGGCCCCTGGACAAGGGCTTGAGTGGA TGGGAATAATCAACCCTATTAGTGTTAGCACAAGCTACGCACAGAAGTTCCAGGGCAGAGTCACCATGACC AGGGACACGTCCACGAGCACAGTCTTCATGGAGCTGAGCAGCCTGAGATCTGAGGACACGGCCGTGTATTA CTGTGCGCGAGGGGGGATACAGCTATGGTTACATTTTGACTACTGGGGCCAGGGAACCCTGGTCACCGTCT CCTCA |
| 342 | 16H2 20D3 23E7 | artificial | aa | QVQLVQSGAEVKKPGASVKVSCKVSGYTFTSYFIHWVRQAPGQGLEWMGIINPISVSTSYAQKFQGRVTMT RDTSTSTVFMELSSLRSEDTAVYYCARGGIQLWLHFDYWGQGTLVTVSS |
| 343 | 26F12 27B3 | artificial | nt | CAGGTGCAGTTGGTGCAGTCTGGGGCTGAGGTGAAGAAGCCTGGGGCCTCAGTGAAGGTTTCCTGCAAGGC ATCTAGATACACCTTCACCAACTACTATATGTCCTGGGTGCGACAGGCCCCTGGACAAGGGCTTGAGTGGA TGGGAATAATCAACCCTAGTGGTGGTGACTCAACCTACGCACAGAAGTTCCAGGGCAGACTCACCATGACC GGGGACACGTCCACGAGCACAGTCTACATGGAGCTGAGCAGCCTGAGATCTGAGGACACGGCCGTGTATTA CTGTGCGAGAGGGGGGATACAACTATGGTTACATTTTGACTACTGGGGCCAGGGAACCCTGGTCACCGTCT CCTCA |
| 344 | 26F12 27B3 | artificial | aa | QVQLVQSGAEVKKPGASVKVSCKASRYTFTNYYMSWVRQAPGQGLEWMGIINPSGGDSTYAQKFQGRLTMT GDTSTSTVYMELSSLRSEDTAVYYCARGGIQLWLHFDYWGQGTLVTVSS |
| 345 | 4B10 4C2 | artificial | nt | CAGGTGCAGTTGGTGGAGTCTGGGGGAGGCGTGGTCCAGCCTGGGAGGTCCCTGAGACTCTCCTGTGCAGC CTCTGGATTCACCTTCAGTAGCTATGACATGCACTGGGTCCGCCAGGCTCCAGGCAAGGGGCTGGAGTGGG TGGCAGTTATATCATATGATGGAACTAATGAATACTATGCAGACTCCGTGAAGGGCCGATTCACCATCTCC AGAGACACTTCCAAGAACACGCTGTATTTGCAAATGAACAGCCTGAGAGCTGAGGACACGGCTGTATATTA CTGTGCGAGAGAACGATATTTTGACTGGTCTTTTGACTACTGGGGCCAGGGAACCCTGGTCAGTGTCTCCT CA |
| 346 | 4B10 4C2 | artificial | aa | QVQLVESGGGVVQPGRSLRLSCAASGFTFSSYDMHWVRQAPGKGLEWVAVISYDGTNEYYADSVKGRFTIS RDTSKNTLYLQMNSLRAEDTAVYYCARERYFDWSFDYWGQGTLVSVSS |
| 347 | 4D3 4F3 | artificial | nt | CAGGTGCAGCTGGTGGAGTCTGGGGGAGGCGTGGTCCAGCCTGGGAGGTCCCTGAGACTCTCCTGTGCAGC GTCTGGATTCTCCTTCAGTAGCTATGACATGGACTGGGTCCGCCAGACTCCAGGCAAGGGGCTGGAGTGGG TGGCAGTTATATGGTATGATGGAAGTAATAAATACTATGCAGACTCCGTGAGGGGCCGATTCACCATCTCC AGAGACAATTCCAAGAACACGCTGTTTCTGCAAATGAACAGCCTGAGAGTCGAGGACACGGCTGTGTATTA CTGTGCGAGAGAAACTGGGGAGGGCTGGTACTTCGATCTCTGGGGCCGTGGCACCCTGGTCACTGTCTCCT CA |
| 348 | 4D3 4F3 | artificial | aa | QVQLVESGGGVVQPGRSLRLSCAASGFSFSSYDMDWVRQTPGKGLEWVAVIWYDGSNKYYADSVRGRFTIS RDNSKNTLFLQMNSLRVEDTAVYYCARETGEGWYFDLWGRGTLVTVSS |
| 349 | 16E2 17E10 20B12 | artificial | nt | CAGGTGCAGCTGGTGGAGTCTGGGGGAGGCGTGGTCCAGCCTGGGAGGTCCCTGAGACTCTCCTGTGCAGC GTCTGGATTCATCTTCAGTAGCTATGGCATGCACTGGGTCCGCCAGACTCCAGGCAAGGGGCTGGAGTGGG TGGCAGTGATATGGTATGATGGAAGTAATAAATACTATGCAGACTCCGTGAAGGGCCGATTCACCATCTCC AGAGACATTTCCAAGAACACGCTGTATCTGCAAATGAACAGCCTGAGAGTCGAGGACACGGCTGTGTATTA CTGTGCGAGAGACGGGTGGGAGCTGTCCTTTGACTACTGGGGCCAGGGAACCCTGGTCACCGTCTCCTCA |

TABLE IIa-continued

Heavy Chain Variable Region Polynucleotide and Amino acid Sequences

| SEQ ID NO. | DESIGNATION | SOURCE | TYPE | SEQUENCE |
|---|---|---|---|---|
| 350 | 16E2 17E10 20B12 | artificial | aa | QVQLVESGGGVVQPGRSLRLSCAASGFIFSSYGMHWVRQTPGKGLEWVAVIWYDGSNKYYADSVKGRFTIS RDISKNTLYLQMNSLRVEDTAVYYCARDGWELSFDYWGQGTLVTVSS |
| 351 | 1D10 2C12 | artificial | nt | CAGGTGCAGCTGGTGGAGTCTGGGGGAGGCGTGGTCCAGCCTGGGAGGTCCCTGAGACTCTCCTGTGCAGC GTCTGGATTCACCTTCAGTAGCTATGGCATGCACTGGGTCCGCCAGGCTCCAGGCAAGGGGCTGGAGTGGG TGTCAGTTATATGGTATGATGGAAGTAATAAATACTATGCAGACTCCGTGAAGGGCCGATTCACCATCTCC AGAGACAATTCCAAGAACACGCTGTATCTGCAAATGAATAGCCTGAGAGCTGAGGACACGGCTGTGTATTA CTGCGCGAGAAGGGCCGGTATAATAGGAACTACAGGCTACTACTACGGTATGGACGTCTGGGGCCAAGGGA CCACGGTCACCGTCTCCTCA |
| 352 | 1D10 2C12 | artificial | aa | QVQLVESGGGVVQPGRSLRLSCAASGFTFSSYGMHWVRQAPGKGLEWVSVIWYDGSNKYYADSVKGRFTIS RDNSKNTLYLQMNSLRAEDTAVYYCARRAGIIGTTGYYYGMDVWGQGTTVTVSS |
| 353 | 16C1 | artificial | nt | CAGGTGCAGCTGCAGGAGTCGGGCCCAGGACTGGTGAAGCCTTCGGAGACCCTGTCCCTCACTTGTACTGT CTCTGGTGGCTCCATCAGTGGTTACTACTGGAGCTGGATCCGGCAGCCCCCAGGGAAGGGACTGGAGTGGA TTGGGTATATCTATTACATTGGGAGCACCAACTACAACCCCTCCCTCAAGAGTCGAGTCACCATGTCAATA GACACGTCCAAGAACCAGTTCTCCCTGACGCTGAGCTCTTTGACCGCTGCGGACACGGCCGTGTATTTCTG TGCGAGAGATGGGAGCAGTGGCTGGTACCGGTGGTTCGACCCCTGGGGCCAGGGAACCCTGGTCACCGTCT CCTCA |
| 354 | 16C1 | artificial | aa | QVQLQESGPGLVKPSETLSLTCTVSGGSISGYYWSWIRQPPGKGLEWIGYIYYIGSTNYNPSLKSRVTMSI DTSKNQFSLTLSSLTAADTAVYFCARDGSSGWYRWFDPWGQGTLVTVSS |
| 355 | 25G10 | artificial | nt | CAGGTGCAGCTGCAGGAGTCGGGCCCAGGACTGGTGAAGCCTTCGGAGACCCTGTCCCTCACCTGCACTGT CTCTGGTGGCTCCATCAGTGGTTACTACTGGAGCTGGATCCGGCAGCCCCCAGGGAAGGGACTGGAGTGGA TTGGGTATATCTATTACATTGGGAGCACCAACTACAACCCCTCCCTCAAGAGTCGAGTCACCATGTCAGTA GACACGTCCAAGAACCAGTTCTCCCTGAAGCTGAGCTCTGTGACCGCTGCGGACACGGCCGTGTATTACTG TGCGAGAGATGGGAGCAGTGGCTGGTACCGGTGGTTCGACCCCTGGGGCCAGGGAACCCTGGTCACCGTCT CCTCA |
| 356 | 25G10 | artificial | aa | QVQLQESGPGLVKPSETLSLTCTVSGGSISGYYWSWIRQPPGKGLEWIGYIYYIGSTNYNPSLKSRVTMSV DTSKNQFSLKLSSVTAADTAVYYCARDGSSGWYRWFDPWGQGTLVTVSS |
| 357 | 16A4 | artificial | nt | CAGGTGCAGCTGCAGGAGTCgGGCCCAGGACTGGCGAAgccttcGGAGACcctgtccctcacctgCACTGT CTCTGGTGACTCCATCACTAGTTACTACTGGAGCTGGATCCGGCAGCCCCCAGGGAAGGGACTGGAGTGGA TTGGGTATATCTATTACAGTGGGAGCACCAATTACAACCCCTCCCTCAAGAGTCGAGTCACCATATCAGTA GACACGTCCAAGAACCAGTTCTCCCTGAAGCTGAGTTCTGTGACCGCTGCGGACACGGCCGTGTATTACTG TGCGAGAGATCAAAGGCGGATAGCAGCAGCTGGTACCCACTTCTACGGTATGGACGTCTGGGGCCAAGGGA CCACGGTCACCGTCTCCTCA |
| 358 | 16A4 | artificial | aa | QVQLQESGPGLAKPSETLSLTCTVSGDSITSYYWSWIRQPPGKGLEWIGYIYYSGSTNYNPSLKSRVTISV DTSKNQFSLKLSSVTAADTAVYYCARDQRRIAAAGTHFYGMDVWGQGTTVTVSS |
| 359 | 1F10 | artificial | nt | CAGGTGCAGCTGCAGGAGTCGGGCCCAGGACTGGTGAAGCCTTCACAGACCCTGTCCCTCACCTGCACTGT CTCTGGTGGCTCCATCAGCAGTGGTGGTTACTACTGGAGCTGGATCCGGCCAGCACCCAGGGAAGGGCCTGG AGTGGATTGGGTACATCTATTACAGTGGGAGCACCTACTACAACCCGTCCCTCACGAGTCGAGTTACCATA TCAGTAGACACGTCTAAGAACCAGTTCTCCCTGAAGCTGAGCTCTGTGACTGCCGCGGACACGGCCGTGTA TTACTGTGCGAGAGATGGAAGCAGTGGCTGGTACTTCCAGCACTGGGGCCAGGGCACCCTGGTCACCGTCT CCTCA |
| 360 | 1F10 | artificial | aa | QVQLQESGPGLVKPSQTLSLTCTVSGGSISSGGYYWSWIRQHPGKGLEWIGYIYYSGSTYYNPSLTSRVTI SVDTSKNQFSLKLSSVTAADTAVYYCARDGSSGWYFQHWGQGTLVTVSS |
| 361 | 4A9 | artificial | nt | CAGGTGCAGCTGCAGGAGTCGGGCCCAGGACTGGTGAAGCCTTCGGAGACCCTGTCCCTCACCTGCACTGT CTCTGGTGGCTCCATCAGTGGTTACTACTGGAGCTGGATCCGGCAGCCCCCAGGGAAAGGGACTGGAGTGGT TTGCATATTTCTCTTACAGTGGGAGCACCAACTACAACCCCTCCCTCAAGAGTCGAGTCACCTTATCAGTA GACACGTCCAAGAACCAGTTCTCCCTGAAGCTGAGCTCTGTGACCGCTGCGGACACGGCCGTGTATTACTG TGCGAGGAACTGGGCCTTCCACTTTGACTTCTGGGGCCAGGGAACCCTGGTCACCGTCTCCTCA |
| 362 | 4A9 | artificial | aa | QVQLQESGPGLVKPSETLSLTCTVSGGSISGYYWSWIRQPPGKGLEWFAYFSYSGSTNYNPSLKSRVTLSV DTSKNQFSLKLSSVTAADTAVYYCARNWAFHFDFWGQGTLVTVSS |
| 363 | 4F7 | artificial | nt | CAGGTGCAGCTGCAGGAGTCGGGCCCAGGACTGGTGAAGCCTTCGGAGACCCTGTCCCTCACCTGCACTGT CTCTGGTGGCTCCATCAGTAGTTACTCCTGGAGCTGGATCCGGCAGCCCCCAGGGAAGGGACTGGAGTGGA TTGGGTATATCTATTACAGTGGGAGCACCAACTACAACCCCTCCCTCAAGAGTCGAGTCACCATATCATTA GACACGTCCAAGAACCAGTTCTCCCTGAAGCTGAGCTCTGTGACCGCTGCGGACACGGCCGTGTATTACTG TGCGAGGAACTGGGCCTTCCACTTTGACTACTGGGGCCAGGGAACCCTGGTCACCGTCTCCTCA |
| 364 | 4F7 | artificial | aa | QVQLQESGPGLVKPSETLSLTCTVSGGSISSYSWSWIRQPPGKGLEWIGYIYYSGSTNYNPSLKSRVTISL DTSKNQFSLKLSSVTAADTAVYYCARNWAFHFDYWGQGTLVTVSS |
| 365 | 22D1 | artificial | nt | CAGGTGCAGCTGGTGCAGTCTGGGGCTGAGGTGAAGAAGCCTGGGGCCTCAGTGAGGGTTTCCTGCAAGGT TTCTGGATACACCTTCACCAGCTACTTTATTCACTGGGTACGCCAGGCCCCTGGACAAGGGCTTGAGTGGA |

TABLE IIa-continued

Heavy Chain Variable Region Polynucleotide and Amino acid Sequences

| SEQ ID NO. | DESIGNATION | SOURCE | TYPE | SEQUENCE |
|---|---|---|---|---|
| | | | | TGGGAATAATCAACCCTATTAGTGTTAGCACAAGCTACGCACAGAAGTTCCAGGGCAGAGTCACCATGACC<br>AGGGACACGTCCACGAGCACAGTCTTCATGGAGCTGAGCAGCCTGAGATCTGAGGACACGGCCGTGTATTA<br>CTGTGCGCGAGGGGGGATACAGCTATGGTTACATTTGGACTACTGGGGCCAGGGAACCCTGGTCACCGTCT<br>CCTCA |
| | 36622D1 | artificial | aa | QVQLVQSGAEVKKPGASVRVSCKVSGYTFTSYFIHWVRQAPGQGLEWMGIINPISVSTSYAQKFQGRVTMT<br>RDTSTSTVFMELSSLRSEDTAVYYCARGGIQLWLHLDYWGQGTLVTVSS |
| | 36719B5 | artificial | nt | CAGGTGCAGTTGGTGCAGTCTGGGGCTGAGGTGAAGAAGCCTGGGGCCTCAGTGAAGGTTTCCTGCAAGGT<br>TTCTGGATACACCTTCACCAGCTACTTTATTCACTGGGTGCGCCAGGCCCCTGGACAAGGGCTTGAATGGA<br>TGGGAATTATCAACCCTATTAGTGTTAGCACAAGCTACGCACAGAAGTTCCAGGGCAGAGTCACCATGACC<br>AGGGACACGTCCACGAGCACAGTCTTCATGGAGCTGAGCAGcCTGAGATCTGAGGACACGGCCGTGTATTA<br>CTGTGCGCGAGGGGGGATACAGCTATGGTTACATTTGGACTACTGGGGCCAGGGAACCCTGGTCACCGTCT<br>CCTCA |
| | 36819B5 | artificial | aa | QVQLVQSGAEVKKPGASVKVSCKVSGYTFTSYFIHWVRQAPGQGLEWMGIINPISVSTSYAQKFQGRVTMT<br>RDTSTSTVFMELSSLRSEDTAVYYCARGGIQLWLHLDYWGQGTLVTVSS |
| | 36925F8 | artificial | nt | CAGGTGCAGCTGGTGCAGTCTGGGGCTGAGGTGAAGAAGCCTGGGGCCTCAGTGAAGGTTCCTGCAAGGC<br>ATCTGGATACACCTTCACCAGCTACTATATTCACTGGGTGCGCCAGGCCCCTGGACAAGGACTTGAGTGGA<br>TGGGAATAATCAACCCCAGTGGTGGTAGCACAAGGTACGCACAGAAGTTCCAGGGCAGAGTCACCATGACC<br>AGGGACACGTCCACGAGCACAGTCTTCATGGAGCTGAGCagcctGAGATCTGAGGACACGGCCGTGTATTA<br>CTGTGCGCGAGGGGGAATACAGCTATGGTTACATTttGACTACTGGGGCCAGGGAACCCTGGTCACCGTCT<br>CCTCA |
| | 37025F8 | artificial | aa | QVQLVQSGAEVKKPGASVKVSCKASGYTFTSYYIHWVRQAPGQGLEWMGIINPSGGSTRYAQKFQGRVTMT<br>RDTSTSTVFMELSSLRSEDTAVYYCARGGIQLWLHFDYWGQGTLVTVSS |
| | 37126D1 | artificial | nt | CAGGTGCAGTTGGTGCAGTCTGGGGCTGAGGTGAAGAAGCCTGGGGCCTCAGTGAAGGTTTCCTGTAAGGC<br>ATCTAGATACACCTTCACCAGCTACTATATGTCCTGGGTGCGACAGGCCCCTGGACAAGGGCTTGAGTGGA<br>TGGGAATAATCCACCCTAGTGGTGGTGACACAACCTACGCACAGAAGTTCCAGGGCAGAGTCACCATGACC<br>GGGGACACGTCCACGAGCACAGTCTACATGGAGCTGAGCAGCCTGAGATCTGAGGACACGGCCGTGTATTA<br>CTGTGCGAGAGGGGGGATAAAACTATGGTTACATTTTGACTATTGGGGCCAGGGAACCCTGGTCACCGTCT<br>CCTCA |
| | 37226D1 | artificial | aa | QVQLVQSGAEVKKPGASVKVSCKASRYTFTSYYMSWVRQAPGQGLEWMGIIHPSGGDTTYAQKFQGRVTMT<br>GDTSTSTVMELSSLRSEDTAVYYCARGGIKLWLHFDYWGQGTLVTVSS |
| | 3734D2 | artificial | nt | CAGGTGCAGCTGGTGGAGTCTGGGGGAGGCGTGGTCCAGCCTGGGAGGTCCCTGAGACTCTCCTGTGCAGC<br>CTCTGGATTCACCTTCAGTAGTTATGACATGCACTGGGTCCGCCAGGCTCCAGGCAAGGGGCTGGAGTGGG<br>TGGCAGTTATATCATATGATGGAACTAATGAATACTATGCAGACTCCGTGAAGGGCCGATTCACCATCTCC<br>AGAGACACTTCCAAGAACACGCTGTATTTGCAAATGAACAGCCTGAGAGCTGAGGACACGGCTGTATATTA<br>CTGTGCGAGAGAACGATATTTTGACTGGTCTTTTGACTACTGGGGCCAGGGAACCCTGGTCAGTGTCTCCT<br>CA |
| | 3744D2 | artificial | aa | QVQLVESGGGVVQPGRSLRLSCAASGFTFSSYDMHWVRQAPGKGLEWVAVISYDGTNEYYADSVKGRFTIS<br>RDTSKNTLYLQMNSLRAEDTAVYYCARERYFDWSFDYWGQGTLVSVSS |
| | 3754E10 | artificial | nt | CAGGTGCAGCTGGTGGAGTCTGGGGGAGGCGTGGTCCAGCCTGGGAGGTCCCTGAGACTCTCCTGTGCAGC<br>GTCTGGATTCACCTTCAGTAGCTATGACATGCACTGGGTCCGCCAGGCTCCAGGCAAGGGGCTGGAGTGGG<br>TGGCAGTTATATGGTATGATGGAAGTAATAAATACTATGCAGACTCCGTGAAGGGCCGATTCACCATCTCC<br>AGAGACAATTCCACGAACACGCTGCATCTGCAAATGAACAGCCCGAGAGCCGAGGACACGGCTGTGTACTA<br>CTGTGCGAGAGAGTATAGGTACAGCTGGTACTTTGACTACTGGGGCCAGGGAACCCTGGTCACCGTCTCCT<br>CA |
| | 3764E10 | artificial | aa | QVQLVESGGGVVQPGRSLRLSCAASGFTFSSYDMHWVRQAPGKGLEWVAVIWYDGSNKYYADSVKGRFTIS<br>RDNSTNTLHLQMNSPRAEDTAVYYCAREYRYSWYFDYWGQGTLVTVSS |
| | 37722G10 | artificial | nt | GAGGTGCAACTGTTGGAGTCTGGGGGAGGCTTGGTACAGCCTGGGGGGTCCCTGAGACTCTCCTGTGCAGC<br>CTCTGGATTCACCTTTAGCAGTTATGCCATGAACTGGGTCCGCCAGGCTCCAGGGAAGGGGCTGGAGTGGG<br>TCTCAACTATTAGTGGTGGTGGTGCTAACACTATACTACGCAGACTCCGTGAAGGGCCGGTTCACCATCTC<br>AGTGACAATTCCAAGAGCACGCTGTATCTGCAAATGAACAGCCTGAGAGCCGCGGACACGGCCGTATATCA<br>CTGTGCGAAAGGGGGAATGGGGGGATACTACGGTATGGACGTCTGGGGCCAAGGGACCACGGTCACCG<br>TCTCCTCA |
| | 37822G10 | artificial | aa | EVQLLESGGGLVQPGGSLRLSCAASGFTFSSYAMNWVRQAPGKGLEWVSTISGGGANTYYADSVKGRFTIS<br>SDNSKSTLYLQMNSLRAADTAVYHCAKGGMGGYYYGMDVWGQGTTVTVSS |
| | 3792C12_LC#1 | artificial | nt | CAGGTGCAGCTGGTGGAGTCTGGGGGAGGCGTGGTCCAGCCTGGGAGGTCCCTGAGACTCTCCTGTGCAGC<br>GTCTGGATTCACCTTCAGTAGCTATGGCATGCACTGGGTCCGCCAGGCTCCAGGCAAGGGGCTGGAGTGGG<br>TGTCAGTTATATGGTATGATGGAAGTAATAAATACTATGCAGACTCCGTGAAGGGCCGATTCACCATCTCC<br>AGAGACAATTCCAAGAACACGCTGTATCTGCAAATGAATAGCCTGAGAGCTGAGGACACGGCTGTATTA<br>CTGCGCGAGAAGGGCCGGTATAATAGGAACTACAGGCTACTACACGTATGGACGTCTGGGGCCAAGGGA<br>CCACGGTCACCGTCTCCTCA |

TABLE IIa-continued

Heavy Chain Variable Region Polynucleotide and Amino acid Sequences

| SEQ ID NO. | DESIGNATION | SOURCE | TYPE | SEQUENCE |
|---|---|---|---|---|
| 380 | 2C12_LC#1 | artificial | aa | QVQLVESGGGVVQPGRSLRLSCAASGFTFSSYGMHWVRQAPGKGLEWVSVIWYDGSNKYYADSVKGRFTIS RDNSKNTLYLQMNSLRAEDTAVYYCARRAGIIGTTGYYYGMDVWGQGTTVTVSS |
| 381 | 2H12_LC#2 | artificial | nt | CAGGTGCAGCTGGTGGAGTCTGGGGGAGGCGTGGTCCAGCCTGGGAGGTCCCTGAGACTCTCCTGTGCAGC GTCTGGATTCACCTTCAGTAGCTATGGCATGCACTGGGTCCGCCAGGCTCCAGGCAAGGGGCTGGAGTGGG TGGCAGTTATATGGTATGATGGAAGTAATAAATACTATACAGACTCCGTGAAGGGCCGATTCACCATCTCC AGAGACAATTCCAAGAACACGCTGTATCTGCAAATGAATAGCCTGAGAGCTGAGGACACGGCTGTGTATTA CTGTGCGAGAAGGGGCCGGTATAATAGGAACTACAGGCTACTACTACGGTATGGACGTCTGGGGCCAAGGGA CCACGGTCACCGTCTCCTCA |
| 382 | 2H12_LC#2 | artificial | aa | QVQLVESGGGVVQPGRSLRLSCAASGFTFSSYGMHWVRQAPGKGLEWVAVIWYDGSNKYYTDSVKGRFTIS RDNSKNTLYLQMNSLRAEDTAVYYCARRAGIIGTTGYYYGMDVWGQGTTVTVSS |
| 383 | 2G6_LC#1 | artificial | nt | CAGGTGCAGTTGGTGGAGTCTGGGGGAGGCGTGGTCCAGCCTGGGAGGTCCCTGAGACTCTCCTGTGCAGC GTCTGGATTCACCTTCAGTAGCTATGGCATGCACTGGGTCCGCCAGGCTCCAGGCAAGGGGCTGGAGTGGG TGGCATTTATATGGTATGATGGAAGTAATAAATACTATGCAGACTCCGTGAAGGACCGATTCACCATCTCC AGAGACAATTCCAAGAACACGCTGTATCTGCAAATGAAAAGCCTGAGAGCTGAGGACACGGCTGTGTATTA CTGTGCGAGAAGGGGCCGGTATAATAGGAACTATAGGCTACTACTACGGTATGGACGTCTGGGGCCAAGGGA CCACGGTCACCGTCTCCTCA |
| 384 | 2G6_LC#1 | artificial | aa | QVQLVESGGGVVQPGRSLRLSCAASGFTFSSYGMHWVRQAPGKGLEWVAFIWYDGSNKYYADSVKDRFTIS RDNSKNTLYLQMKSLRAEDTAVYYCARRAGIIGTIGYYYGMDVWGQGTTVTVSS |
| 385 | 2H12 | artificial | nt | CAGGTGCAGCTGGTGGAGTCTGGGGGAGGCGTGGTCCAGCCTGGGAGGTCCCTGAGACTCTCCTGTGCAGC GTCTGGATTCACCTTCAGTAGCTATGGCATGCACTGGGTCCGCCAGGCTCCAGGCAAGGGGCTGGAGTGGG TGGCAGTTATATGGTATGATGGAAGTAATAAATACTATACAGACTCCGTGAAGGGCCGATTCACCATCTCC AGAGACAATTCCAAGAACACGCTGTATCTGCAAATGAATAGCCTGAGAGCTGAGGACACGGCTGTGTATTA CTGTGCGAGAAGGGGCCGGTATAATAGGAACTACAGGCTACTACTACGGTATGGACGTCTGGGGCCAAGGGA CCACGGTCACCGTCTCCTCA |
| 386 | 2H12 | artificial | aa | QVQLVESGGGVVQPGRSLRLSCAASGFTFSSYGMHWVRQAPGKGLEWVAVIWYDGSNKYYTDSVKGRFTIS RDNSKNTLYLQMNSLRAEDTAVYYCARRAGIIGTTGYYYGMDVWGQGTTVTVSS |
| 387 | 2G6 | artificial | nt | CAGGTGCAGTTGGTGGAGTCTGGGGGAGGCGTGGTCCAGCCTGGGAGGTCCCTGAGACTCTCCTGTGCAGC GTCTGGATTCACCTTCAGTAGCTATGGCATGCACTGGGTCCGCCAGGCTCCAGGCAAGGGGCTGGAGTGGG TGGCATTTATATGGTATGATGGAAGTAATAAATACTATGCAGACTCCGTGAAGGACCGATTCACCATCTCC AGAGACAATTCCAAGAACACGCTGTATCTGCAAATGAAAAGCCTGAGAGCTGAGGACACGGCTGTGTATTA CTGTGCGAGAAGGGGCCGGTATAATAGGAACTATAGGCTACTACTACGGTATGGACGTCTGGGGCCAAGGGA CCACGGTCACCGTCTCCTCA |
| 388 | 2G6 | artificial | aa | QVQLVESGGGVVQPGRSLRLSCAASGFTFSSYGMHWVRQAPGKGLEWVAFIWYDGSNKYYADSVKDRFTIS RDNSKNTLYLQMKSLRAEDTAVYYCARRAGIIGTIGYYYGMDVWGQGTTVTVSS |
| 389 | 23A10 | artificial | nt | CAGGTGCAGCTGGTGGAGTCTGGGGGAGGCGTGGTCCAGCCTGGGAGGTCCCTGAGACTCTCCTGTGCAGC GTCTGGATTCACCTTCAGTCGCTATGGCATACACTGGGTCCGCCAGGCTCCAGGCAAGGGGCTGGAGTGGG TGGCAGTTATATGGTATGATGGAAGTAATAAATACTATGCAGACTCCGTGAAGGGCCGATTCACCATCTCC AGAGACAATTCCAAGAACACGCTGTATCTGCTAATGAACAGCCTGAGAGCCGAGGACTCGGCTGTGTATTA CTGTGCGAGAAGGGCCGGTATACCTGGAACTACGGGCTACTACTATGGTATGGACGTCTGGGGCCAAGGGA CCACGGTCACCGTCTCCTCA |
| 390 | 23A10 | artificial | aa | QVQLVESGGGVVQPGRSLRLSCAASGFTFSRYGIHWVRQAPGKGLEWVAVIWYDGSNKYYADSVKGRFTIS RDNSKNTLYLLMNSLRAEDSAVYYCARRAGIPGTTGYYYGMDVWGQGTTVTVSS |
| 391 | 5E3 | artificial | nt | GAGGTGCAGTTGGTGGAGTCTGGGGGAGGCCTGGTCAAGCCTGGGGGGTCCCTGAGACTCTCCTGTGCAGC CTCTGGATTCACCTTCAGTAGCTATAGCATGCACTGGGTCCGCCAGGCTCCAGGGAAGGGGCTGGAGTGGG TCTCATCCATTAGTAGTAGTAGTAGTTACATATACTACGCAGACTCAGTGAAGGGCCGATTCACCATCTCC AGAGACAACGCCAAGAACTCACTGTATCTGCAAATGAACAGCCTGAGAGCCGAGGACACGGCTGTGTATTA CTGTGCGAGAGGGGAAACTGGAACTAACTACTACTACTACGGTATGGACGTCTGGGGCCAAGGGACCACGG TCACCGTCTCCTCA |
| 392 | 5E3 | artificial | aa | EVQLVESGGGLVKPGGSLRLSCAASGFTFSSYSMHWVRQAPGKGLEWVSSISSSSSYIYYADSVKGRFTIS RDNAKNSLYLQMNSLRAEDTAVYYCARGETGTNYYYGMDVWGQGTTVTVSS |

TABLE IIB

Light Chain Variable Region Polynucleotide and Amino acid Sequences

| SEQ ID NO. | DESIGNATION | SOURCE | TYPE | SEQUENCE |
|---|---|---|---|---|
| 393 | 17H8 23B6 28D10 | artificial | nt | GACATTGTATTGACCAGtctCCAGGCACCCTGTCTTTGTCTCCAGGGGAAAGAGCCACCCTCTCCTGCAGGGCCAGTCAGAGTGT TGCCGGCAGTCACTAGCCTGGTACCAGCAGAAACCTGGCCAGGCTCCCAGGCTCCTCATCTCTGGTGCATCCAGCAGGCCACTG GCATCCCAGACAGCAGTTCAGTGGCAGTGGGTCTGGGACAGACTTCACTCTCACCATCAGCAGACTGGAGCCTGAAGATTTTGCAGTG TATTACTGTCAGCAGTATGGTAAATCACCGGATGAAAGGA |
| 394 | 17H8 23B6 28D10 | artificial | aa | DIVLTQSPGTLSLSPGERATLSCRASQSVAGSYLAWYQQKPGQAPRLLISGASSRATGIPDRFSGSGSGTDFTLTISRLEPEDFAVYYCQQYGK SPITPFGQGTRLEMKG |
| 395 | 4A2 5B4 5C5 | artificial | nt | GAAATTGTGTTGACGCAGTCTCCAGGCACCCTGTCTTTGTCTCCAGGGGAAAGAGCCACCCTCTCTTGCAGGGCCAGTCAGGAATAT TAGCAGCAGTACTTAGCCTGGTACCAGCAGAAACCTGGCCAGGCTCCCAGGCTCCTCATCTATGGTGCATCCAGCAGGGCCACTG GCATCCCAGACAGGTTCAGTGGCAGTGGGTCTGGGACAGACTTCACTCTCACCATCAGCAGACTGGAGCCTGAAGATTTTACAGTG TATTACTGTCAGCAGTATGGTAGCTCACTTTCGGCCCTGGGACCAAAGTGGATATCAAACGA |
| 396 | 4A2 5B4 5C5 | artificial | aa | EIVLTQSPGTLSLSPGERATLSCRASRNISSSYLAWYQQKPGQAPRLLIYGPSSRATGIPDRFSGSGSGTDFTLTISRLEPEDFTVYYCQQYGS SFTFGPGTKVDIKR |
| 397 | 16H2 20D3 23E7 | artificial | nt | CAGTCTGCCTGACTCAGCCACCCTCAGCGACTGGGACCTCAGGAGAGTCACCATCTCTTGTTCTGGAAGCAGCTCCAACAT CGGAAGTAATTTTGTAAACTGGTACCAGCAACAACTCCAGGAACGGCTCCCAAAGTCCTCATGGGCATCAGCGGCCCTCAG GGGTCCCTGACCGATTCTCTGGCTCCAAGTCTGGCACCTCAGCCTCCTCCTGGCCATCAGTGGGCTCCAGTCGAGATGAGTCTGAT TATTACTGTGCAACATGGGATGACAGCCTGAATGGTTGGGTGTTCGGCGGAGGGACCAAGCTGACCGTCCTAGGT |
| 398 | 16H2 20D3 23E7 | artificial | aa | QSALTQPPSATGTPGQRVTISCSGSSSNIGSNFVNWYKQLPGTAPKVLIYTNNQRPSGVPDRFSGSKSGTSASLAISGLQSEDESDYYCATWDD SLNGWVFGGGTKLTVLG |
| 399 | 26F12 27B3 | artificial | nt | CAGTCTGTGCTGACTCAGTCAGCCTCACCCTCAGCGCTGGGACCTCCGGAGAGTCACCATCTCCTGTTCTGGAAGCCGCTCCAACAT CGGAAGTAATTTTGTAAACTGGTACCAGCAGCTCCCAGGAACGGCCTCCAGGGCTCCTCATCTATTATCAGCGGCCCTCAG GGGTCCCTGACCGATTCTCTGGCTCCAAGTCTGGCACCTCAGCCTCCTCTGGCCATCAGTGGGCTCCAGTCGAGATGAGGCTGAT TATTACTGTGCAGTATGGGATGACAGTCTGAATGGTTGGGTGTTCGGCGGAGGGACCAAGCTGACCGTCCTAGGT |
| 400 | 26F12 27B3 | artificial | aa | QSVLTQSPSASGTPGQKVTISCSGSSRSNIGSNFVNWYQQLPGTAPKLLIYTNYQRPSGVPDRFSGSKSGTSASLAISGLQSEDEADYYCAVWDD SLNGWVFGGGTKLTVLG |
| 401 | 4B10 4C2 | artificial | nt | GAAATTGTATTGACCCAGTCTCCAGGCACCCTGTCTTTGTCTCCAGGGGAAAGAGCCACCCTCTCCTGCAGGGCCAGTCAGAGTGT TAGCAACACCTACTTAGCCTGGTACCAGCAGAAACCTGGCCAGGCTCCCAGGCTCCTCATCTATGGTGCATCCAGCAGGGCCACTG GCATCCCAGACAGATTCAGTGGCAGTGGGTCTGGGACAGACTTCGCTCTCACCATCAGCAGTCTGGAGCCTGAAGATTTTGCAGTG TATTACTGTCAGCAGTACTCgtgacGTTCGGCCAAGGGACCAAGGTCGAAATCaaacGA |
| 402 | 4B10 4C2 | artificial | aa | EIVLTQSPGTLSLSPGERATLSCRASQSVSNTYLAWYHQRPGQAPRLLIYGASSRATGIPDRFSGSGSGTDFALTISSLEPEDFAVYYCQQYSN SWTFGQGTKVEIKR |
| 403 | 4D3 4F3 | artificial | nt | GAAATTGTGTTGACGCAGTCTCCAGGCACCCTGTCTTTGTCTCCAGGGGAAAGAGCCACCCTCTCCTGCAGGGCCAGTCAGAGTGT TAGCAGCAGCTACTTAGCCTGGTACCAGCAGAAACCTGGCCAGGCTCCCAGGCTCCTCATCTATGGTGCATCCAGCAGGGCCACTG GCATCCCAGACAGGTTCAGTGGCAGTGGGTCTGGGACAGACTTCACTCTCACCATCAGCAGACTGGAACCTGAAGATTTTGCAGTG TATTACTGTCAGCAGTATGGTAGCTCGGACGTTCGGCCAAGGGACCAAGGTGAAATCAAACGA |

TABLE IIB-continued

Light Chain Variable Region Polynucleotide and Amino acid Sequences

| SEQ ID NO. | DESIGNATION | SOURCE | TYPE | SEQUENCE |
|---|---|---|---|---|
| 404 | 4D3 4F3 | artificial | aa | EIVLTQSPGTLSLSPGERATLSCRASQSVSSSYLAWYQQKPGQAPRLLIYGASSRATGIPDRFSGSGSGTDFTLTISRLEPEDFAVYYCQQYGS SWTFGQGTKVEIKR |
| 405 | 16E2 17E10 20B12 | artificial | nt | GACATCCAGATGACCCAGTCTCCATCCTCACTGTCTGCATCTGTAGGAGACAGAGTCACCATCACTTGTCGGGCGAGTCAGGGCAT TAGCAATTATTTAGCCTGGTTACAGCAGAAACCAGGGAAAGCCCCTAAGCTCCTGATCTATGCTGCATCCAGTTTGCAAAGTGGGG TCCCATCAAGGTTCAGTGGCAGTGGATCTGGGACAGATTTCACTCTCACCATCAGCCTGCAGCCTGAAGATTTTGCAACTTAT TACTGCCAACACTATTTACTTACCCTCGGACGTTCGGCCAAGGGACCAAGGTGGAAATCAAACGA |
| 406 | 16E2 17E10 20B12 | artificial | aa | DIQMTQSPSSLSASVGDRVTITCRASQGISNYLAWLQQKPKPKPAPKSLIYAASSLQSGVPSKFSGSGSGTDFTLTISSLQPEDFATYYCQHYFTY PRTFGQGTKVEIKR |
| 407 | 1D10 2C12 | artificial | nt | TCCTATGCCTGACTCAGCCACCCTCAGTGTCCGTGTCCCCAGGACAGCAGCCTCACCTGCTCTGGAGATAGATTGGGGGA AAAATATACTTGTGTATCAGCAGAGGCCAGGCCAGTCCCCTTTGCTGGTCATCTATCAAGATACCAAGCGGCCCTCAGGGATCC CTGAGCGATTCTCTGCTTCCACCTCTGTAACAGCACTGTGTATTCGGCGGAGGGACCAAGCTGACCGTCCTAGGT TGTCAGGCGTGGGACAGCAGACAGCACTGTGGTATTCGGCGGAGGGACCAAGCTGACCGTCCTAGGT |
| 408 | 1D10 2C12 | artificial | aa | SYALTQPPSVSVSPGQTASLTCSGDRLGEKYTCWYQQRPGQSPLLVIYQDTKRPSGIPERFSGSTSGNTATLTISGTQAMDEADYYCQAWDS STVVFGGGTKLTVLG |
| 409 | 16C1 | artificial | nt | GAAATTGTTGACGCAGTCTCCAGGCACCCTGTCTTTGTCTCCAGGGGAAAAGAGCCACCCTCTCCTGCAGGGCCAGTCAGAGTGT TAGCAGCAGCTACTTAGCCTGGTACCAGCAGAAACCTGGCCAGGCTCCCAGGCTCCTCATCTTTGGTGCATCCAGCAGGGCCACTG GCATCCCAGACAGGTTCAGTGGCAGTGGGTCTGGGACAGActTCACTCTCACCATCAGCAGACTGGAGCCTGAAGATTTTGCAGTG TATCACTGTCAGCAGTATGGTAACTCACCGCTCACTTTCGGCGGAGGGACCAAGGTGGAGATCAAACGA |
| 410 | 16C1 | artificial | aa | EIVLTQSPGTLSLSPGERATLSCRASQSVSSSYLAWYQQKPGQAPRLLIFGASSRATGIPDRFSGSGSGTDFTLTISGLEPEDFAVYHCQQYGN SPLTFGGGTKVEIKR |
| 411 | 25G10 | artificial | nt | GAAATTGTTGACGCAGTCTCCAGGCACCCTGTCTTTGTCTCCAGGGGAAAAGAGCCACCCTCTCCTGCAGGGCCAGTCAGAGTGT TAGCAGCAGTTATTTAGCCTGGTACCAGCAGAAACCTGGCCAGGCTCCCAGGCTCCTCATCTATGGTACATCCAGCAGGGCCACTG GCATCCCAGACAGGTTCAGTGGCAGTGGGTCTGGGACAGACTTCACTCTCACCATCAGCAGACTGGAGCCTGAAGATTTTGCAGTG TATTATTGTCAGCAGTACGGTAGCCGTCACTTTCGGCGGAGGGACCAAGGTGGAGATCAAACGA |
| 412 | 25G10 | artificial | aa | EIVLTQSPGTLSLSPGERATLSCRASQSVSSSYLAWYQQKPGQAPRLLIFGASSRATGIPDRFSGSGSGTDFTLTISRLEPEDFAVYHCQQYGN SPLTFGGGTKVEIKR |
| 413 | 16A4 | artificial | nt | GAAATTGTGTTGACGCAGTCTCCAGGCACCCTGTCTTTGTCTCCAGGGGAAAAGAGCCACCCTCTCCTGCAGGGCCAGTCAGAGTGT TAGCAGCAGCTACTTAGCCTGGTACCAGCAGAAACCTGGCCAGGCTCCCAGGCTCCTCATCTATGGTGCATCCAGCAGGGCCACTG GCATCCCAGACAGGTTCAGTGGCAGTGGGTCTGGGACAGACTTCACTCTCACCATCAGCAGACTGGAGCCTGAAGATTTTGCAGTG TATTACTGTCAGCAGTATGGTAGCTCACCGTTCACTTTCGGCGGAGGGACCAAGGTGGAGATCAAACGA |
| 414 | 16A4 | artificial | aa | EIVLTQSPGTLSLSPGERATLSCRASQSVSSSYLAWYQQKPGQAPRLLIYGTSSRATGIPDRFSGSGSGTDFTLTISRLEPEDFAVYYCQQYGS SPFTFGGGTKVEIKR |
| 415 | 1F10 | artificial | nt | GAAATTGTGTTGACGCAGTCTCCAGGCACCCTGTCTTTGTCTCCAGGGGAAAAGAGCCACCCTCTCCTGCAGGGCCAGTCGGAGTAT TAGCAGCAGCTACTTAGCCTGGTACCAGCAGAAACCTGGCCAGGCTCCCAGGCTTCATCGTCATCAGCAGGGCCACTG GCATCCCAGACAGGTTCAGTGGCAGTGGGTCTGGGACAGACTTCACTCTCACCATCAGCAGACTGGAGCCTGAAGATTTGCAGTG TATTACTGTCAGCAGTATGGTAGCTCATTCACTTTCGGCCCTGGGACCAAAGTGGATATCAAACGA |

TABLE IIB-continued

Light Chain Variable Region Polynucleotide and Amino acid Sequences

| SEQ ID NO. | DESIGNATION | SOURCE | TYPE | SEQUENCE |
|---|---|---|---|---|
| 416 | 1F10 | artificial | aa | EIVLTQSPGTLSLSPGERATLSCRASRSISSSYLAWYQQKPGQAPRLLIYGPSSRATGIPDRFSGSGSGTDFTLTISRLEPEDFAV YYCQQYGSSFTFGPGTKVDIKR |
| 417 | 4A9 | artificial | nt | CAGTCTGTCGACCAGCAGCCGCCCTCAGTGTCTGGGCCCCCAGGACAGAGGGTCACCATCTCCTGCACTGGGAGCAGTCCAACAT CGGGACAGGTTATGCTGTACACTGTATCAGCAGCTTCCAGGAACAGCCCCCAAACTCCTCATCTATGGTAACAACAATCGGCCCT CAGGGGTTCCTGACCGATTCTCTGGCTCCAAGTCTGGCACCTCAGCCTCCCTGGCCATCACTGGGCTCCAGGCTGAGGATGAGGCT GATTATTACTGCCAGTCCTATGACAGCAGCCTGAGTGGTTGGGTGTTCGGCGGAGGGACCAAGCTGACCGTCCTAGGT |
| 418 | 4A9 | artificial | aa | QSVLTQPPSVSGAPGQRVTISCTGSSSNIGTGYAVHWYQQFPPGTAPKLLIYGNNNRPSGVPDRFSGSKSGTSASLAITGLQAEDEADYYCQSYD SRLSGWVFGGGTKLTVLG |
| 419 | 4F7 | artificial | nt | CAGTCTGTgCTGACGCAGCCGCCCTCAGTGTCTGGGGCCCCAGGGCAGAGGGTCACCATCTCCTGCACTGGGAGCAGTCCAATAT CGGGACAGGTTATGATGTACACTGTATCAGCAGctTCCAGGAACAGCCCCCAAACTCCTCATCCATGGTAACAGCAATCGGCCCT CAGGGGTCCCTGACCGATTCTCTGGCTCCAAGTCTGGCACCTCAGCCTCCCTGGCCATCACTGGGCTCCAGGCTGAGGATGAGGCT GATTATTACTGCCAGTCCTATGACAGCAGCCTGAGTGGTTGGGTGTTCGGCGGAGGGACCAAGCTGACCGTCCTAGGT |
| 420 | 4F7 | artificial | aa | QSVLTQPPSVSGAPGQRVTISCTGSSSNIGTGYDVHWYQQLPGTAPKLLIIHGNSNRPSGVPDRFSGSKSGTSASLAITGLQAEDEADYYCQSYD SSLSGWVFGGGTRLLTVLG |
| 421 | 22D1 | artificial | nt | CAGTCTGCGCTGACTCAGCCGCACCCTCAGCGACTGGGACTCTCCAGGACAGCTCCAGGACAGCCCCGGACAGAGGGTCACCATCTCTTGTTCTGGAAGCAGTCCAACAT CGGAAGCAATTTTGTAAACTGGTACCAGCAGCTCCCAGGAACGGCCCCCAAAGTCCTCATCTATAATAATCAGCGGCCCTCAG GGGTCCCTGACCGATTCTCTGGCTCCAAGTCTGGCACCTCAGCCTCCCTGGCCATCAGTGGGCTCCAGTCTGAGGATGAGTCTGAT TATTACTGCGCAACATGGGATGACAGTATGAATGTTGGGTGTTCGGCGGAGGGACCAAACTGACCGTCCTAGGT |
| 422 | 22D1 | artificial | aa | QSALTQPPSATGTPGQRVTISCSGSSNIGSNFVNWYKQLPGTAPKVLLIYTNNQRPSGVPDRFSGSKSGTSASLAISGLQSEDESDYYCATWDD SMNGWVFGGGTKLTVLG |
| 423 | 19B5 | artificial | nt | CAGTCTGCGCTGACTCAGCCGCACCCTCAACGACTGGGACCCCCAGGACAGAGGGTCACCATCTCTTGTTCTGGAAGCAGTCCAACAT CGGAAGCAATTTTGTAAACTGGTACCAGCAGCTCCCAGGAACGGCCCCCAAAGTCCTCATCTATAATAATCAGCGGCCCTCAG GGTCCCTGACCGATTCTCTGGCTCCAAGTCTGGCACCTCAGCCTCCCTGGCCATCAGTGGGCTCCAGTCTGAGGATGAGTCTGAT TATTACTGCGCAACATGGGATGACAGTATGAATGTTGGGTGTTCGGCGGAGGGACCAAGCTGACCGTCCTAGGT |
| 424 | 19B5 | artificial | aa | QSALTQPPSTTGTPGQRVTISCSGSRSNIGSNFVNWYKQLPGTAPKVLLIYTNNQRPSGVPDRFSGSKSGTSASLAISGLQSEDESDYYCATWDD SMNGWVFGGGTKLTVLG |
| 425 | 25F8 | artificial | nt | CAGTCTGCGCTGactCAGCCGCACCCTCAGCGACTGGGACCCCCAGGACAGAGGGTCACCATCTCTTGTTCTGGAAGCAGTCCAACAT CGGAAGGAATTTTGTAAACTGGTACCAGCAGCTCCCAGGAACGGCCCCCAAAGTCCTATTATACTAATAATCAGCGGCCCTCAG GGTCCCTGACCGATTCTCTGGCTCCAAGTCTGGCACCTCAGCCTCCCTGGCCATCAGTGGGCTCCAGTCTGAGGATGAGTCTGAT TATTACTGTGCAGCATGGGATGGAAGCAGCCTGAATGGTTGGGTGTTCGGCGGAGGGACCAAGCTGACCGTCCTAGGT |
| 426 | 25F8 | artificial | aa | QSALTQPPSATGTPGQRVTISCSGSSNIGRNFVNWYKQLPGTAPKVLLIYTNNQRPSGVPDRFSGSKSGTSASLAISGLQSEDESDYYCAAWDD SLNGWVFGGGTKLTVLG |
| 427 | 26D1 | artificial | nt | CACTCTGTGCTGACTCAGTCACCCTCAGCGCTCGGGACTCCCAGGACAGAGGGTCACCATCTCTTGTTCTGGAAGCCGCTCCAACAT CGGAAGTAATTTTGTAAACTGGTACCAGCAGCTCCCAGGAACGGCCCCCAAACTCCTCATCTATACTAATAATCAGCGGCCCTCAG GGGTCCCTGACCGATTCTCTGGCTCCAAGTCTGGCACCTCAGCCTCCCTGGCCATCAGTGGGCTCCAGTCTGAGGATGAGGCTGAT TATTACTGTGCAGCATATGGGATGACAGCAGCCTGAATGGTTGGGTGTTCGGCGGAGGGACCAAGCTGACCGTCCTAGGT |

TABLE IIB-continued

Light Chain Variable Region Polynucleotide and Amino acid Sequences

| SEQ ID NO. | DESIGNATION | SOURCE | TYPE | SEQUENCE |
|---|---|---|---|---|
| 428 | 26D1 | artificial | aa | HSVLTQSPSASGTPGQRVTISCSGSRSNIGSNFVNWYQQLPGTAPKLLIYTNNQRPSGVPDRFSGSKSGTSASLAISGLQSEDEADYYCAVWDD SLNGWVFGGGTKLTVLG |
| 429 | 4D2 | artificial | nt | GAAATTGTATTGACGCAGTCTCCAGGCACCCTGTCTTTGTCTCCAGGGGAAAGAGCCACCCTCTCCTGCAGGGCCAGTCAGAGTGT TAGCAACACCTACTTAGCCTGGTACCAGCAGAAACCTGGCCAGGCTCCCAGGCTCCTCATCTATGGTGCATCAGCAGGGCCCCTG GCATCCCAGACAGCAGTTCAGTGGCAGTGGGTCTGGGACAGACTTCACTCTCACCATCAGCAGACTGGAGCCTGAAGATTTTGCAGTG TATTACTGTCAGCAGTATAGTAACTCGTGACGTTCGGCCAAGGGACCAAGGTGGAAATCAAACGA |
| 430 | 4D2 | artificial | aa | EIVLTQSPGTLSLSPGERATLSCRASQSVSNTYLAWYHQRPGQAPRLLIYGASSRAAGIPDRFSGSGSGTDFTLTISRLEPEDFAVYYCQQYSN SWTFGQGTKVEIKR |
| 431 | 4E10 | artificial | nt | GAAATTGTTGACGCAGTCTCCAGGCACCCTGTCTTTGTCTCCAGGGGAAAGAGCCACCCTCTCCTGCAGGGCCAGTCAGAGTGT TGGCAGCACTAGCCTGGTACCAGCAGAAACCTGGCCAGGCTCCCAGGCTCCTCATCTATGGTGCATCAGCAGGGTCACTG GCATCCCAGACAGCAGTTCAGTGGCAGTGGGTCTGGGACAGATTCACTCTCACCATCAGCAGACTGGAGCCTGAAGATTTTGCAGTG TATTACTGTCAGCAATATAGTAACTCGTGACGTTCGGCCAAGGGACCAAGGTGGAAATCAAACGA |
| 432 | 4E10 | artificial | aa | EIVLTQSPGTLSLSPGERATLSCRASQSVGSSLAWYQQKPGQAPRLLIYGASSRVTGIPDRFSGSGSGTDFTLTISRLEPEDFAVYYCQQYSN SWTFGQGTKVEIKR |
| 433 | 22G10 | artificial | nt | GAAATAGTGATGACGCAGTCTCCAGTCTCCTCTCTAGGGGAAAGAGCCACCCTCTCCTGCAGGGCCAGTCAGAGTAT TAGCAGCAACTTAGCCTGGTTTCAGCAGAAACCTGGCCAGGCTCCCAGATCTCACTCTCAGCAGTGCATTTACCAGGGCCACTGGTA TCCCAGCCAGGGTCAGTGGCAGTGGGTCTGGGACAGAGTTCACTCTCACCATCAGCAGCCTGCAGTCTGAAGATTTTGCAGTTTAT TACTGTCAGCAGTATAATTACTGGCCGCTCCACTTTCGGCGGAGGGACCAAGGTGGAGATCAAGCGA |
| 434 | 22G10 | artificial | aa | EIVMTQSPVTLSLSLGERATLSCRASQSISSNLAWFQQKPGQKPGQAPRLLIYGAFTRATGIPARVSGSGSGTEFTLTISSLQSEDFAVYYCQQYNYW PLTFGGGTKVEIKR |
| 435 | 2C12_LC#1 | artificial | nt | GATGTTGTGATGactCAGtCTccActctcctgcCCGTCACCCTTGGACAGCCGGCCctCAtcctgCAGGtCTAGTCAAAGCT cgtaTACAGTGATGAAACacctACTTGAATTGGTTTCAGCAGAGGCCAGGCCAATCTCCAAGGgcctaATTTATAAGGTTTCTA ACTGGGActctgGGGtCCCAGACAGATTCAGCgCAGTGGGTCAGGCActGATTTCACactGACAGGTGAggctgaG GATGTTGGGGTTTATTactgCATGCAAGGTATAGTGGCCGTGCAGTTTTGGCCAGGGACCAAGCTGGAGATCAAaCgA |
| 436 | 2C12_LC#1 | artificial | aa | DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCM QGIVWPCSFGQGTKLEIKR |
| 437 | 2H12_LC#2 | artificial | nt | GATGTTGTGATGACAGTCTCCACTCTCCCTGCCCGTCACCCTTGGACAGCCGGCCTCCATCTCCTGCAGGTCTAGTCAAAGCCT CGTATACAGTGATGAAACACCTACTTGAATTGGTTTCAGCAGAGGCCAGGCCAATCTCCAAGGCGCCTAATTTATAAGGTTTCTA ACTGGGACTCTGGGGTCCCAGACAGAATCAGCGCAGTGGGTCAGGCACTGATTTCACACTGACAGGTGAGGCTGAG GATGTTGGGGTTTATTACTGCATGCAAGGTATACACTGTGGCCGTGCAGTTTTGGCCAGGGGACCAAGCTGGAGATCAAACGA |
| 438 | 2H12_LC#2 | artificial | aa | DVVMTQSPLSLPVTLGQPASISCRSSQSLVYSDGNTYLNWFQQRPGQSPRRLIYKVSNWDSGVPDRISGSGSGTDFTLKISRVEAEDVGVYYCM QDTLWPCSFGQGTKLEIKR |
| 439 | 2G6_LC#1 | artificial | nt | GaTGTTGTGATGACTcagtctccaTCTCCCTGCCCGTCACCCttggacaGCCGGCCTccaTCTCCTGCAGGTCTAGTCAAAGCCT CGTATACAGTGATGAAACACCTACTTGAATTGGTTCAGCAGAGGCCAGGCCAGTCAGGCACTGATTTCACGCGCCTAATTTATCAGGTTTCTA ACTGGGACTCTGGGGTCCCAGACAGATTCAGCGCAGTGGGTCAGGCACTGATTTCACACTGAAAATCAGCAGGTGAGGCTGAG GATGTTGGGATTTATTACTGCATGCAAGATACACTGTGGCCGTGCAGTTTTGGCCAGGGGACCAAGCTGGAGATCAAACGA |

TABLE IIB-continued

Light Chain Variable Region Polynucleotide and Amino acid Sequences

| SEQ ID NO. | DESIGNATION | SOURCE | TYPE | SEQUENCE |
|---|---|---|---|---|
| 440 | 2G6_LC#1 | artificial | aa | DVVMTQSPLSLPVTLGQPASISCRSSQSLVYSDGNTYLNWFQQRPGQSPRRLIYQVSNWDSGVPDRFSGSGSGTDFTLKISRVEAEDVGIYYCM QDTLWPCSFGQGTKLEIKR |
| 441 | 2H12 | artificial | nt | TCCTATGAGCTGACTCAGCCACCCTCAGTGTCCCGTGTCCCCAGGACAGACAGCCAGCATCTGCTCTGGAGATAGATTGGGGGA AAAATATACTTGCTGGTATCAGCAGAGGCCAGGCCAGTCCCCTTTGCTGGTCATCTATCAAGATACCAAGCGCCCTCAGGGATCC CTGAGCGATTCTCTGGCTCCAACTCTGGTAACACAGCCACTCTGACCATCAGCGGACCCAGGCTATGAGGCTGACTATTAC TGTCAGGCGTGGGACAGCAGCACTGTGTATTCGGCGGAGGGACCAAGCTGACCGTCCTAGGT |
| 442 | 2H12 | artificial | aa | SYELTQPPSVSVSPGQTASITCSGDRLGEKYTCWYQQRPGQSPLLVIYQDTKRPSGIPERFSGSNSGNTATLTISGTQPMDEADYYCQAWDSST VVFGGGTKLTVLG |
| 443 | 2G6 | artificial | nt | TCCTATGAGCTGACTCAGCCACCCTCAGTGTCCCGTGTCCCCAGGACAGACAGCCAGCATCTGCTCTGGAGATAGGTTGGGGGA AAAATATACTTGCTGGTATCAGCAGAGGCCAGGCCAGTCCCCTTTGCTGGTCATCTATCAAGATACCAAGCGGCCCTCAGGGATCC CTGAGCGATTCTCTGGCTCCAACTCTGGTAACACAGCCACTCTGACCATCAGCGGACCCAGGCTATGATGAGGCTGACTATTAC TGTCAGGCGTGGGACAGCAGCACTGTGTATTCGGCGGAGGGACCAAGCTGACCCTCCTAGGT |
| 444 | 2G6 | artificial | aa | SYELTQPPSVSVSPGQTASITCSGDRLGEKYTCWYQQRPGQSPLLVIYQDTKRPSGIPERFSGSNSGNTATLTISGTQAMDEADYYCQAWDSST VVFGGGTKLTVLG |
| 445 | 23A10 | artificial | nt | TCCTATGAGCTGACTCAGCCACCCTCAGTGTCCCGTGTCCCCAGGACAGACAGCCAGCATCTGCTCTGGAGATAGATTGGGGGA GAAATATGTTTGCTGGTATCAGCAGAAGCCAGGCCAGTCCCTATACTGTTCATCTATCAAGATAATAAGTGGCCCTCAGGGATCC CTGAGCGATTCTCTGGCTCCAACTCTGGTAACACAGCCACTCTGACCATCAGCGGACCCAGGCTATGGATGACGCTGACTATTAC TGTCAGGCGTGGGACAGCAGCACTGTGTATTCGGCGGAGGGACCAAGCTGACCGTCCTAGGT |
| 446 | 23A10 | artificial | aa | SYELTQPPSVSVSPGQTASITCSGDRLGEKYVCWYQQKPGQSPLLVIYQDNKWPSGIPERFSGSNSGNTATLTISGTQAMDEADYYCQAWDSST VVFGGGTKLTVLG |
| 447 | 5E3 | artificial | nt | TCCTATGAGCTGACTCAGCCACCCTCAGTGTCCCGTGTCCCCAGGACAGACAGCCAGCATCCACCTGCTCTGGAGATAAATTGGGGGA TGAATATGTTGCTGGTATCAGCAGAAGCCAGGCCAGTCCCTGTCATCTATCAAGATAGCAAGCGGCCCTCAGGGATCC CTGAGCGATTCTCTGGCTCCAACTCTGGGAACACAGCCACTCTGACCATCAGCGGACCCAGGCTATGGATGAGGCTGACTATTAC TGTCAGGCGTGGGACAGCAGCACTGTGTATTCGGCGGAGGGACCAAGCTGACCGTCCTAGGT |
| 448 | 5E3 | artificial | aa | SYELTQPPSVSVSPGQTASITCSGDKLGDEYACWYQQKPGQSPVLVIYQDSKRPSGIPERFSGSNSGNTATLTISGTQAMDEADYYCQAWDSST VVFGGGTKLTVLG |

TABLE IIc

Heavy Chain Variable Region Polynucleotide and Amino acid Sequences

13586_HC [hu anti-<huCDH19> 4F3 VH]
QVQLVESGGGVVQPGRSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSS
SEQ ID NO: 449

13589_HC [hu anti-<huCDH19> 4A9 VH]
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSS
SEQ ID NO: 450

13590_HC [hu anti-<huCDH19> 4B10 VH]
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSS
SEQ ID NO: 451

13874_HC [hu anti-<huCDH19> 17H8.2 VH]
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSS
SEQ ID NO: 452

13875_HC [hu anti-<huCDH19> 16C1.1 VH]
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSS
SEQ ID NO: 453

13876_HC [hu anti-<huCDH19> 16A4.1 VH]
QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTTVTVSS
SEQ ID NO: 454

13877_HC [hu anti-<huCDH19> 22G10.1 VH]
EVQLLESGGGLVQPGGSLRLSCAASGFTFSSYAMNWVRQAPGKGLEWVSTISGGGANTYYADSVKGR
FTISSDNSKSTLYLQMNSLRAADTAVYHCAKGGMGGYYYGMDVWGQGTTVTVSS
SEQ ID NO: 455

13878_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSS
SEQ ID NO: 456

13879_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 457

13880_HC [hu anti-<huCDH19> 25F8.1 VH]
QVQLVQSGAEVKKPGASVKVSCKASGYTFTSYYTHWVRQAPGQGLEWMGIINPSGGSTRYAQKFQGR
VTMTRDTSTSTVFMELSSLRSEDTAVYYCARGGIQLWLHFDYWGQGTLVTVSS
SEQ ID NO: 458

13881_HC [hu anti-<huCDH19> 26F12.1 VH]
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSS
SEQ ID NO: 459

13882_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSS
SEQ ID NO: 460

13883_HC [hu anti-<huCDH19> 25G10.1 VH]
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSS
SEQ ID NO: 461

13885_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 462

14022_HC [hu anti-< huCDH19> 4A2 VH]
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSS
SEQ ID NO: 463

TABLE IIc-continued

Heavy Chain Variable Region Polynucleotide and Amino acid Sequences

14024_HC [hu anti-<huCDH19> 4A2 (1-472)(Q17E,H47P) VH]
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSS
SEQ ID NO: 464

14025_HC [hu anti-<huCDH19> 4A2 VH]
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSS
SEQ ID NO: 465

14026_HC [hu anti-<huCDH19> 4A2 (1-472)(Q17E,H47P) VH]
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSS
SEQ ID NO: 466

14027_HC [hu anti-<huCDH19> 4A2 (1-472)(Q17E,H47P,D111E) VH]
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGWYFQYWGQGTLVTVSS
SEQ ID NO: 467

14028_HC [hu anti-<huCDH19> 4A2 (1-472)(Q17E,H47P,D111E,W134Y) VH]
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGYYFQYWGQGTLVTVSS
SEQ ID NO: 468

14029_HC [hu anti-<huCDH19> 4A2 VH]
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSS
SEQ ID NO: 469

14030_HC [hu anti-<huCDH19> 4F3 (1-471)(R17G) VH]
QVQLVESGGGVVQPGGSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSS
SEQ ID NO: 470

14031_HC [hu anti-<huCDH19> 4F3 (1-471)(R17G,T47A) VH]
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGRGTLVTVSS
SEQ ID NO: 471

14032_HC [hu anti-<huCDH19> 4F3 (1-471)(R17G,T47A,R141Q) VH]
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGQGTLVTVSS
SEQ ID NO: 472

14033_HC [hu anti-<huCDH19> 4F3 (1-471)(R17G,T47A,D61E,D72E,R141Q) VH]
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGWYFDLWGQGTLVTVSS
SEQ ID NO: 473

14034_HC [hu anti-<huCDH19> 4F3 (1-471)(R17G,T47A,D61E,D72E,W134Y,R141Q) VH]
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGYYFDLWGQGTLVTVSS
SEQ ID NO: 474

14039_HC [hu anti-<huCDH19> 2G6 (1-477)(R17G,D61E,D72E,K94N) VH]
QVQLVESGGGVVQPGGSLRLSCAASGFTFSSYGMHWVRQAPGKGLEWVAFIWYEGSNKYYAESVKD
RFTISRDNSKNTLYLQMNSLRAEDTAVYYCARRAGIIGTIGYYYGMDVWGQGTTVTVSS
SEQ ID NO: 475

14040_HC [hu anti-<huCDH19> 16C1.1 VH]
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSS
SEQ ID NO: 476

14041_HC [hu anti-<huCDH19> 16C1.1 (1-469)(T92K) VH]
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSS
SEQ ID NO: 477

14042_HC [hu anti-<huCDH19> 16C1.1 (1-469)(T92K,D109E) VH]
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCAREGSSGWYRWFDPWGQGTLVTVSS
SEQ ID NO: 478

TABLE IIc-continued

Heavy Chain Variable Region Polynucleotide and Amino acid Sequences

14043_HC [hu anti-<huCDH19> 16C1.1 (1-469)(T92K,W132Y,W135Y) VH]
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGYYRYFDPWGQGTLVTVSS
SEQ ID NO: 479

14044_HC [hu anti-<huCDH19> 16C1.1 (1-469)(T92K) VH]
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSS
SEQ ID NO: 480

14045_HC [hu anti-<huCDH19> 17H8.2 VH]
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSS
SEQ ID NO: 481

14046_HC [hu anti-<huCDH19> 17H8.2 (1-471)(D109E) VH]
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSS
SEQ ID NO: 482

14047_HC [hu anti-<huCDH19> 17H8.2 (1-471)(D109E,W132Y) VH]
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGYYDAFDIWGQGTMVTVSS
SEQ ID NO: 483

14048_HC [hu anti-<huCDH19> 17H8.2 (1-471)(D109E) VH]
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSS
SEQ ID NO: 484

14049_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSS
SEQ ID NO: 485

14050_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSS
SEQ ID NO: 486

14051_HC [hu anti-<huCDH19> 4F7 (1-468)(W113Y) VH]
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNYAFHFDYWGQGTLVTVSS
SEQ ID NO: 487

14052_HC [hu anti-<huCDH19> 4B10 (1-471)(R17G,D61E,D72E,W134Y) VH]
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDYSFDYWGQGTLVSVSS
SEQ ID NO: 488

14053_HC [hu anti-<huCDH19> 4B10 VH]
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSS
SEQ ID NO: 489

14054_HC [hu anti-<huCDH19> 4B10 (1-471)(R17G) VH]
QVQLVESGGGVVQPGGSLRLSCAASGFTFSSYDMHWVRQAPGKGLEWVAVISYDGTNEYYADSVKG
RFTISRDTSKNTLYLQMNSLRAEDTAVYYCARERYFDWSFDYWGQGTLVSVSS
SEQ ID NO: 490

14055_HC [hu anti-<huCDH19> 4B10 (1-471)(R17G,D61E,D72E) VH]
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDWSFDYWGQGTLVSVSS
SEQ ID NO: 491

14056_HC [hu anti-<huCDH19> 4A9 VH]
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSS
SEQ ID NO: 492

14057_HC [hu anti-<huCDH19> 4A9 (1-468)(F55I,A56G) VH]
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSS
SEQ ID NO: 493

TABLE IIc-continued

Heavy Chain Variable Region Polynucleotide and Amino acid Sequences

14058_HC [hu anti-<huCDH19> 4A9 (1-468)(F55I,A56G) VH]
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSS
SEQ ID NO: 494

14059_HC [hu anti-<huCDH19> 4A9 (1-468)(F55I,A56G,W113Y) VH]
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNYAFHFDFWGQGTLVTVSS
SEQ ID NO: 495

14060_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSS
SEQ ID NO: 496

14061_HC [hu anti-<huCDH19> 20D3.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSS
SEQ ID NO: 497

14062_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSS
SEQ ID NO: 498

14063_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSS
SEQ ID NO: 499

14064_HC [hu anti-<huCDH19> 20D3.1 (1-469)(W133Y) VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSS
SEQ ID NO: 500

14065_HC [hu anti-<huCDH19> 22G10.1 (1-470)(S82R,A99E) VH]
EVQLLESGGGLVQPGGSLRLSCAASGFTFSSYAMNWVRQAPGKGLEWVSTISGGGANTYYADSVKGR
FTISRDNSKSTLYLQMNSLRAEDTAVYHCAKGGMGGYYYGMDVWGQGTTVTVSS
SEQ ID NO: 501

14066_HC [hu anti-<huCDH19> 22G10.1 (1-470)(A99E,H105Y) VH]
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYYCAKGGMGGYYYGMDVWGQGTTVTVSS
SEQ ID NO: 502

14067_HC [hu anti-<huCDH19> 22G10.1 (1-470)(A99E) VH]
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSS
SEQ ID NO: 503

14068_HC [hu anti-<huCDH19> 22G10.1 (1-470)(A99E) VH]
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSS
SEQ ID NO: 504

14069_HC [hu anti-<huCDH19> 22G10.1 (1-470)(D72E,A99E) VH]
EVQLLESGGGLVQPGGSLRLSCAASGFTFSSYAMNWVRQAPGKGLEWVSTISGGGANTYYAESVKGRF
TISSDNSKSTLYLQMNSLRAEDTAVYHCAKGGMGGYYYGMDVWGQGTTVTVSS
SEQ ID NO: 505

14070_HC [hu anti-<huCDH19> 22G10.1 (1-470)(H105Y) VH]
EVQLLESGGGLVQPGGSLRLSCAASGFTFSSYAMNWVRQAPGKGLEWVSTISGGGANTYYADSVKGR
FTISSDNSKSTLYLQMNSLRAADTAVYYCAKGGMGGYYYGMDVWGQGTTVTVSS
SEQ ID NO: 506

14071_HC [hu anti-<huCDH19> 16A4.1 (1-474)(T144L) VH]
QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTLVTVSS
SEQ ID NO: 507

14072_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 508

TABLE IIc-continued

Heavy Chain Variable Region Polynucleotide and Amino acid Sequences

14073_HC [hu anti-<huCDH19> 19B5.1 (1-469)(W133Y) VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSS
SEQ ID NO: 509

14074_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 510

14075_HC [hu anti-<huCDH19> 19B5.1 VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 511

14076_HC [hu anti-<huCDH19> 19B5.1 (1-469)(W133Y) VH]
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSS
SEQ ID NO: 512

14077_HC [hu anti-<huCDH19> 23A10.3 (1-474)(L92Q) VH]
QVQLVESGGGVVQPGRSLRLSCAASGFTFSRYGIHWVRQAPGKGLEWVAVIWYDGSNKYYADSVKGR
FTISRDNSKNTLYLQMNSLRAEDSAVYYCARRAGIPGTTGYYYGMDVWGQGTTVTVSS
SEQ ID NO: 513

14078_HC [hu anti-<huCDH19> 23A10.3 (1-474)(R17G,L92Q) VH]
QVQLVESGGGVVQPGGSLRLSCAASGFTFSRYGIHWVRQAPGKGLEWVAVIWYDGSNKYYADSVKG
RFTISRDNSKNTLYLQMNSLRAEDSAVYYCARRAGIPGTTGYYYGMDVWGQGTTVTVSS
SEQ ID NO: 514

14079_HC [hu anti-<huCDH19> 23A10.3 (1-474)(R17G,D61E,D72E,L92Q) VH]
QVQLVESGGGVVQPGGSLRLSCAASGFTFSRYGIHWVRQAPGKGLEWVAVIWYEGSNKYYAESVKGR
FTISRDNSKNTLYLQMNSLRAEDSAVYYCARRAGIPGTTGYYYGMDVWGQGTTVTVSS
SEQ ID NO: 515

14080_HC [hu anti-<huCDH19> 23A10.3 VH]
QVQLVESGGGVVQPGRSLRLSCAASGFTFSRYGIHWVRQAPGKGLEWVAVIWYDGSNKYYADSVKGR
FTISRDNSKNTLYLLMNSLRAEDSAVYYCARRAGIPGTTGYYYGMDVWGQGTTVTVSS
SEQ ID NO: 516

14081_HC [hu anti-<huCDH19> 25G10.1 VH]
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSS
SEQ ID NO: 517

14082_HC [hu anti-<huCDH19> 25G10.1 (1-469)(D109E,W132Y,W135Y) VH]
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCAREGSSGYYRYFDPWGQGTLVTVSS
SEQ ID NO: 518

14083_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSS
SEQ ID NO: 519

14084_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSS
SEQ ID NO: 520

14085_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSS
SEQ ID NO: 521

14086_HC [hu anti-<huCDH19> 26D1.1 VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSS
SEQ ID NO: 522

14087_HC [hu anti-<huCDH19> 26D1.1 (1-469)(W133Y) VH]
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLYLHFDYWGQGTLVTVSS
SEQ ID NO: 523

TABLE IIc-continued

Heavy Chain Variable Region Polynucleotide and Amino acid Sequences

14088_HC [hu anti-<huCDH19> 26D1.1 (1-469)(R27G,G82R) VH]
QVQLVQSGAEVKKPGASVKVSCKASGYTFTSYYMSWVRQAPGQGLEWMGIIHPSGGDTTYAQKFQGR
VTMTRDTSTSTVYMELSSLRSEDTAVYYCARGGIKLWLHFDYWGQGTLVTVSS
SEQ ID NO: 524

14089_HC [hu anti-<huCDH19> 26F12.1 VH]
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSS
SEQ ID NO: 525

14090_HC [hu anti-<huCDH19> 26F12.1 VH]
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSS
SEQ ID NO: 526

14091_HC [hu anti-<huCDH19> 26F12.1 (1-469)(W133Y) VH]
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSS
SEQ ID NO: 527

14092_HC [hu anti-<huCDH19> 26F12.1 (1-469)(W133Y) VH]
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSS
SEQ ID NO: 528

14093_HC [hu anti-<huCDH19> 25F8.1 VH]
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSS
SEQ ID NO: 529

14094_HC [hu anti-<huCDH19> 25F8.1 VH]
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSS
SEQ ID NO: 530

14095_HC [hu anti-<huCDH19> 25F8.1 (1-469)(F90Y) VH]
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSS
SEQ ID NO: 531

14096_HC [hu anti-<huCDH19> 25F8.1 (1-469)(F90Y) VH]
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSS
SEQ ID NO: 532

14097_HC [hu anti-<huCDH19> 25F8.1 (1-469)(F90Y,W133Y) VH]
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLYLHFDYWGQGTLVTVSS
SEQ ID NO: 533

14098_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 534

14099_HC [hu anti-<huCDH19> 22D1.1 VH]
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSS
SEQ ID NO: 535

14100_HC [hu anti-<huCDH19> 22D1.1 (1-469)(W133Y) VH]
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSS
SEQ ID NO: 536

14101_HC [hu anti-<huCDH19> 22D1.1 (1-469)(W133Y) VH]
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSS
SEQ ID NO: 537

14102_HC [hu anti-<huCDH19> 22D1.1 (1-469)(F90Y) VH]
QVQLVQSGAEVKKPGASVRVSCKVSGYTFTSYFIHWVRQAPGQGLEWMGIINPISVSTSYAQKFQGRV
TMTRDTSTSTVYMELSSLRSEDTAVYYCARGGIQLWLHLDYWGQGTLVTVSS
SEQ ID NO: 538

TABLE IIc-continued

Heavy Chain Variable Region Polynucleotide and Amino acid Sequences

13591_HC [hu anti-<huCDH19> 4F7 VH]
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSS
SEQ ID NO: 539

14301_HC [hu anti-<huCDH19> 2G6 VH]
QVQLVESGGGVVQPGRSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSS
SEQ ID NO: 540

14302_HC [hu anti-<huCDH19> 2G6 (1-477)(R17G,K94N) VH]
QVQLVESGGGVVQPGGSLRLSCAASGFTFSSYGMHWVRQAPGKGLEWVAFIWYDGSNKYYADSVKD
RFTISRDNSKNTLYLQMNSLRAEDTAVYYCARRAGIIGTIGYYYGMDVWGQGTTVTVSS
SEQ ID NO: 541

14303_HC [hu anti-<huCDH19> 2G6 (1-477)(D61E,D72E) VH]
QVQLVESGGGVVQPGRSLRLSCAASGFTFSSYGMHWVRQAPGKGLEWVAFIWYEGSNKYYAESVKD
RFTISRDNSKNTLYLQMKSLRAEDTAVYYCARRAGIIGTIGYYYGMDVWGQGTTVTVSS
SEQ ID NO: 542

14304_HC [hu anti-<huCDH19> 2G6 (1-477)(R17G) VH]
QVQLVESGGGVVQPGGSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSS
SEQ ID NO: 543

TABLE IId

Light Chain Variable Region Amino acid Sequences

13586_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 544

13589_LC [hu anti-<huCDH19> 4A9 VL]
QSVLTQPPSVSGAPGQRVTISCTGSSSNIGTGYAVHWYQQFPGTAPKLLIYGNNNRPSGVPDRFSGSKSG
TSASLAITGLQAEDEADYYCQSYDSRLSGWVFGGGTKLTVLG
SEQ ID NO: 545

13590_LC [hu anti-<huCDH19> 4B10 VL]
EIVLTQSPGTLSLSPGERATLSCRASQSVSNTYLAWYHQRPGQAPRLLIYGASSRATGIPDRFSGSGSGTD
FALTISSLEPEDFAVYYCQQYSNSWTFGQGTKVEIKR
SEQ ID NO: 546

13874_LC [hu anti-<huCDH19> 17H8.2 VL]
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKG
SEQ ID NO: 547

13875_LC [hu anti-<huCDH19> 16C1.1 VL]
EIVLTQSPGTLSLSPGERATLSCRASQSVSSSYLAWYQQKPGQAPRLLIFGASSRATGIPDRFSGSGSGTD
FTLTISGLEPEDFAVYHCQQYGNSPLTFGGGTKVEIKR
SEQ ID NO: 548

13876_LC [hu anti-<huCDH19> 16A4.1 VL]
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGGGTKVEIKR
SEQ ID NO: 549

13877_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKR
SEQ ID NO: 552

13878_LC [hu anti-<huCDH19> 20D3.1 VL]
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSLNGWVFGGGTKLTVLG
SEQ ID NO: 554

13879_LC [hu anti-<huCDH19> 22D1.1 VL]
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSMNGWVFGGGTKLTVLG
SEQ ID NO: 555

TABLE IId-continued

Light Chain Variable Region Amino acid Sequences

13880_LC [hu anti-<huCDH19> 25F8.1 VL]
QSALTQPPSATGTPGQRVTISCSGSSSNIGRNFVNWYKQLPGTAPKVLIYTNNQRPSGVPDRFSGSKSGT
SASLAISGLQSEDESDYYCAAWDDSLNGWVFGGGTKLTVLG
SEQ ID NO: 556

13881_LC [hu anti-<huCDH19> 26F12.1 VL]
QSVLTQSPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLG
SEQ ID NO: 557

13882_LC [hu anti-<huCDH19> 26D1.1 VL]
HSVLTQSPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLG
SEQ ID NO: 555

13883_LC [hu anti-<huCDH19> 25G10.1 VL]
EIVLTQSPGTLSLSPGERATLSCRASQSVSSSYLAWYQQKPGQAPRLLIFGASSRATGIPDRFSGSGSGTD
FTLTISRLEPEDFAVYHCQQYGNSPLTFGGGTKVEIKR
SEQ ID NO: 556

13885_LC [hu anti-<huCDH19> 19B5.1 VL]
QSALTQPPSTTGTPGQRVTISCSGSRSNIGSNFVNWYKQLPGTAPKVLIYTNNQRPSGVPDRFSGSKSGTS
ASLAISGLQSEDESDYYCATWDDSMNGWVFGGGTKLTVLG
SEQ ID NO: 557

14022_LC [hu anti-<huCDH19> 4A2 (1-236)(N30Q) VL]
EIVLTQSPGTLSLSPGERATLSCRASRQISSSYLAWYQQKPGQAPRLLIYGPSSRATGIPDRFSGSGSGTDF
TLTISRLEPEDFTVYYCQQYGSSFTFGPGTKVDIKR
SEQ ID NO: 558

14024_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKR
SEQ ID NO: 559

14025_LC [hu anti-<huCDH19> 4A2 (1-236)(N30Q,T102A) VL]
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKR
SEQ ID NO: 560

14026_LC [hu anti-<huCDH19> 4A2 (1-236)(N30Q,T102A) VL]
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKR
SEQ ID NO: 561

14027_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKR
SEQ ID NO: 562

14028_LC [hu anti-<huCDH19> 4A2 (1-236)(N30Q,T102A,P141Q) VL]
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKR
SEQ ID NO: 563

14029_LC [hu anti-<huCDH19> 4A2 (1-236)(R29Q,N30S) VL]
EIVLTQSPGTLSLSPGERATLSCRASQSISSSYLAWYQQKPGQAPRLLIYGPSSRATGIPDRFSGSGSGTDF
TLTISRLEPEDFTVYYCQQYGSSFTFGPGTKVDIKR
SEQ ID NO: 564

14030_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 565

14031_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 566

14032_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 567

TABLE IId-continued

Light Chain Variable Region Amino acid Sequences

14033_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 568

14034_LC [hu anti-<huCDH19> 4F3 VL]
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKR
SEQ ID NO: 569

14039_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLG
SEQ ID NO: 570

14040_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKR
SEQ ID NO: 571

14041_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKR
SEQ ID NO: 572

14042_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKR
SEQ ID NO: 573

14043_LC [hu anti-<huCDH19> 16C1.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKR
SEQ ID NO: 574

14044_LC [hu anti-<huCDH19> 16C1.1 (1-235)(G95R,H105Y,G141Q) VL]
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGQGTKVEIKR
SEQ ID NO: 575

14045_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKR
SEQ ID NO: 576

14046_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKR
SEQ ID NO: 577

14047_LC [hu anti-<huCDH19> 17H8.2 (1-235)(G149R) VL]
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKR
SEQ ID NO: 578

14048_LC [hu anti-<huCDH19> 17H8.2 (1-235)(S57Y,G149R) VL]
DIVLTQSPGTLSLSPGERATLSCRASQSVAGSYLAWYQQKPGQAPRLLIYGASSRATGIPDRFSGSGSGT
DFTLTISRLEPEDFAVYYCQQYGKSPITFGQGTRLEMKR
SEQ ID NO: 579

14049_LC [hu anti-<huCDH19> 4F7 (1-239)(H57Y) VL]
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYDSSLSGWVFGGGTRLTVLG
SEQ ID NO: 580

14050_LC [hu anti-<huCDH19> 4F7 (1-239)(H57Y,D110E) VL]
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYESSLSGWVFGGGTRLTVLG
SEQ ID NO: 581

14051_LC [hu anti-<huCDH19> 4F7 (1-239)(D110E) VL]
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYESSLSGWVFGGGTRLTVLG
SEQ ID NO: 582

TABLE IId-continued

Light Chain Variable Region Amino acid Sequences

14052_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKR
SEQ ID NO: 583

14053_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKR
SEQ ID NO: 584

14054_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKR
SEQ ID NO: 585

14055_LC [hu anti-<huCDH19> 4B10 (1-236)(H45Q,A90T) VL]
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKR
SEQ ID NO: 586

14056_LC [hu anti-<huCDH19> 4A9 (1-239)(F47L) VL]
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLG
SEQ ID NO: 587

14057_LC [hu anti-<huCDH19> 4A9 (1-239)(F47L) VL]
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLG
SEQ ID NO: 588

14058_LC [hu anti-<huCDH19> 4A9 (1-239)(F47L,D110E) VL]
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLG
SEQ ID NO: 589

14059_LC [hu anti-<huCDH19> 4A9 (1-239)(F47L,D110E) VL]
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLG
SEQ ID NO: 590

14060_LC [hu anti-<huCDH19> 20D3.1 (1-235)(S102A) VL]
QSALTQPPSATGTPGQRVTISCSGSSSNIGSNFVNWYKQLPGTAPKVLIYTNNQRPSGVPDRFSGSKSGTS
ASLAISGLQSEDEADYYCATWDDSLNGWVFGGGTKLTVLG
SEQ ID NO: 591

14061_LC [hu anti-<huCDH19> 20D3.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLG
SEQ ID NO: 592

14062_LC [hu anti-<huCDH19> 20D3.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLG
SEQ ID NO: 593

14063_LC [hu anti-<huCDH19> 20D3.1 (1-235)(K45Q,S102A,D111E,N135Q) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESLQGWVFGGGTKLTVLG
SEQ ID NO: 594

14064_LC [hu anti-<huCDH19> 20D3.1 (1-235)(W109Y) VL]
QSALTQPPSATGTPGQRVTISCSGSSSNIGSNFVNWYKQLPGTAPKVLIYTNNQRPSGVPDRFSGSKSGTS
ASLAISGLQSEDESDYYCATYDDSLNGWVFGGGTKLTVLG
SEQ ID NO: 595

14065_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKR
SEQ ID NO: 596

14066_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKR
SEQ ID NO: 597

TABLE IId-continued

Light Chain Variable Region Amino acid Sequences

14067_LC [hu anti-<huCDH19> 22G10.1 (1-234)(Q97E,S98P) VL]
EIVMTQSPVTLSLSLGERATLSCRASQSISSNLAWFQQKPGQAPRLLIYGAFTRATGIPARVSGSGSGTEF
TLTISSLEPEDFAVYYCQQYNYWPLTFGGGTKVEIKR
SEQ ID NO: 598

14068_LC [hu anti-<huCDH19> 22G10.1 (1-234)(V78F,Q97E,S98P) VL]
EIVMTQSPVTLSLSLGERATLSCRASQSISSNLAWFQQKPGQAPRLLIYGAFTRATGIPARFSGSGSGTEF
TLTISSLEPEDFAVYYCQQYNYWPLTFGGGTKVEIKR
SEQ ID NO: 599

14069_LC [hu anti-<huCDH19> 22G10.1 (1-234)(V78F,Q97E,S98P) VL]
EIVMTQSPVTLSLSLGERATLSCRASQSISSNLAWFQQKPGQAPRLLIYGAFTRATGIPARFSGSGSGTEF
TLTISSLEPEDFAVYYCQQYNYWPLTFGGGTKVEIKR
SEQ ID NO: 600

14070_LC [hu anti-<huCDH19> 22G10.1 VL]
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKR
SEQ ID NO: 601

14071_LC [hu anti-<huCDH19> 16A4.1 (1-235)(G141Q) VL]
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGQGTKVEIKR
SEQ ID NO: 602

14072_LC [hu anti-<huCDH19> 19B5.1 (1-235)(K45Q,S102A) VL]
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLG
SEQ ID NO: 603

14073_LC [hu anti-<huCDH19> 19B5.1 (1-235)(K45Q,S102A) VL]
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLG
SEQ ID NO: 604

14074_LC [hu anti-<huCDH19> 19B5.1 (1-235)(T11V,K45Q,S102A) VL]
QSALTQPPSVTGTPGQRVTISCSGSRSNIGSNFVNWYQQLPGTAPKVLIYTNNQRPSGVPDRFSGSKSGT
SASLAISGLQSEDEADYYCATWDDSMNGWVFGGGTKLTVLG
SEQ ID NO: 605

14075_LC [hu anti-<huCDH19> 19B5.1 (1-235)(T11V,K45Q,S102A,D111E,N135Q) VL]
QSALTQPPSVTGTPGQRVTISCSGSRSNIGSNFVNWYQQLPGTAPKVLIYTNNQRPSGVPDRFSGSKSGT
SASLAISGLQSEDEADYYCATWDESMQGWVFGGGTKLTVLG
SEQ ID NO: 606

14076_LC [hu anti-<huCDH19> 19B5.1 (1-235)(T11V,K45Q,S102A,W109Y,D111E,N135Q) VL]
QSALTQPPSVTGTPGQRVTISCSGSRSNIGSNFVNWYQQLPGTAPKVLIYTNNQRPSGVPDRFSGSKSGT
SASLAISGLQSEDEADYYCATYDESMQGWVFGGGTKLTVLG
SEQ ID NO: 607

14077_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLG
SEQ ID NO: 608

14078_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLG
SEQ ID NO: 609

14079_LC [hu anti-<huCDH19> 23A10.3 (1-231)(C42S,D110E) VL]
SYELTQPPSVSVSPGQTASITCSGDRLGEKYVSWYQQKPGQSPILVIYQDNKWPSGIPERFSGSNSGNTA
TLTISGTQAMDEADYYCQAWESSTVVFGGGTKLTVLG
SEQ ID NO: 610

14080_LC [hu anti-<huCDH19> 23A10.3 (1-231)(C42Y) VL]
SYELTQPPSVSVSPGQTASITCSGDRLGEKYVYWYQQKPGQSPILVIYQDNKWPSGIPERFSGSNSGNTA
TLTISGTQAMDEADYYCQAWDSSTVVFGGGTKLTVLG
SEQ ID NO: 611

14081_LC [hu anti-<huCDH19> 25G10.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKR
SEQ ID NO: 612

TABLE IId-continued

Light Chain Variable Region Amino acid Sequences

14082_LC [hu anti-<huCDH19> 25G10.1 (1-235)(H105Y) VL]
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKR
SEQ ID NO: 613

14083_LC [hu anti-<huCDH19> 26D1.1 (1-235)(S7P) VL]
HSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLG
SEQ ID NO: 614

14084_LC [hu anti-<huCDH19> 26D1.1 (1-235)(H1Q,S7P) VL]
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLG
SEQ ID NO: 615

14085_LC [hu anti-<huCDH19> 26D1.1 (1-235)(H1Q,S7P,W109Y) VL]
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDDSLNGWVFGGGTKLTVLG
SEQ ID NO: 616

14086_LC [hu anti-<huCDH19> 26D1.1 (1-235)(H1Q,S7P,W109Y,D111E,N135Q) VL]
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLG
SEQ ID NO: 617

14087_LC [hu anti-<huCDH19> 26D1.1 (1-235)(H1Q,S7P,W109Y,D111E,N135Q) VL]
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLG
SEQ ID NO: 618

14088_LC [hu anti-<huCDH19> 26D1.1 (1-235)(H1Q,S7P) VL]
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLG
SEQ ID NO: 619

14089_LC [hu anti-<huCDH19> 26F12.1 (1-235)(S7P) VL]
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLG
SEQ ID NO: 620

14090_LC [hu anti-<huCDH19> 26F12.1 (1-235)(S7P,D111E) VL]
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLG
SEQ ID NO: 621

14091_LC [hu anti-<huCDH19> 26F12.1 (1-235)(S7P,D111E) VL]
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLG
SEQ ID NO: 622

14092_LC [hu anti-<huCDH19> 26F12.1 (1-235)(S7P,W109Y,D111E,N135Q) VL]
QSVLTQPPSASGTPGQKVTISCSGSRSNIGSNFVNWYQQLPGTAPKLLIYTNYQRPSGVPDRFSGSKSGTS
ASLAISGLQSEDEADYYCAVYDESLQGWVFGGGTKLTVLG
SEQ ID NO: 623

14093_LC [hu anti-<huCDH19> 25F8.1 (1-235)(K45Q) VL]
QSALTQPPSATGTPGQRVTISCSGSSSNIGRNFVNWYQQLPGTAPKVLIYTNNQRPSGVPDRFSGSKSGT
SASLAISGLQSEDESDYYCAAWDDSLNGWVFGGGTKLTVLG
SEQ ID NO: 624

14094_LC [hu anti-<huCDH19> 25F8.1 (1-235)(K45Q,S102A) VL]
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLG
SEQ ID NO: 625

14095_LC [hu anti-<huCDH19> 25F8.1 (1-235)(K45Q,S102A) VL]
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLG
SEQ ID NO: 626

14096_LC [hu anti-<huCDH19> 25F8.1 (1-235)(K45Q,S102A,D111E) VL]
QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLNGWVFGGGTKLTVLG
SEQ ID NO: 627

TABLE IId-continued

Light Chain Variable Region Amino acid Sequences

14097_LC [hu anti-<huCDH19> 25F8.1 (1-235)(K45Q,S102A,D111E,N135Q) VL]
QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLQGWVFGGGTKLTVLG
SEQ ID NO: 628

14098_LC [hu anti-<huCDH19> 22D1.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLG
SEQ ID NO: 629

14099_LC [hu anti-<huCDH19> 22D1.1 (1-235)(K45Q,S102A,D111E,N135Q) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESMQGWVFGGGTKLTVLG
SEQ ID NO: 630

14100_LC [hu anti-<huCDH19> 22D1.1 (1-235)(K45Q,S102A,W109Y,D111E,N135Q) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATYDESMQGWVFGGGTKLTVLG
SEQ ID NO: 631

14101_LC [hu anti-<huCDH19> 22D1.1 (1-235)(K45Q,S102A,W109Y) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATYDDSMNGWVFGGGTKLTVLG
SEQ ID NO: 632

14102_LC [hu anti-<huCDH19> 22D1.1 (1-235)(K45Q,S102A) VL]
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLG
SEQ ID NO: 633

13591_LC [hu anti-<huCDH19> 4F7 VL]
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYDSSLSGWVFGGGTRLTVLG
SEQ ID NO: 634

14301_LC [hu anti-<huCDH19> 2G6 (1-234)(D110E) VL]
SYELTQPPSVSVSPGQTASITCSGDRLGEKYTCWYQQRPGQSPLLVIYQDTKRPSGIPERFSGSNSGNTAT
LTISGTQAMDEADYYCQAWESSTVVFGGGTKLTVLG
SEQ ID NO: 635

14302_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLG
SEQ ID NO: 636

14303_LC [hu anti-<huCDH19> 2G6 (1-234)(C42S,D110E) VL]
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLG
SEQ ID NO: 637

14304_LC [hu anti-<huCDH19> 23A10.3 (1-231)(C42S) VL]
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLG
SEQ ID NO: 638

Anti-CDH19 Variable and Constant Region Polynucleotide and Amino Acid Sequences

TABLE IIIa

Heavy Chain Variable and Contant Region Polynucleotide and Amino acid Sequences 2G6
CAGGTGCAGTTGGTGGAGTCTGGGGGAGGCGTGGTCCAGCCTGGGAGGTCCCTGAGACTCTCCTGT
GCAGCGTCTGGATTCACCTTCAGTAGCTATGGCATGCACTGGGTCCGCCAGGCTCCAGGCAAGGGG
CTGGAGTGGGTGGCATTTATATGGTATGATGGAAGTAATAAATACTATGCAGACTCCGTGAAGGAC
CGATTCACCATCTCCAGAGACAATTCCAAGAACACGCTGTATCTGCAAATGAAAAGCCTGAGAGCT
GAGGACACGGCTGTGTATTACTGTGCGAGAAGGGCCGGTATAATAGGAACTATAGGCTACTACTAC
GGTATGGACGTCTGGGGCCAAGGGACCACGGTCACCGTCTCTAGTGCCTCCACCAAGGGCCCATCG
GTCTTCCCCCTGGCACCCTCCTCCAAGAGCACCTCTGGGGGCACAGCGGCCCTGGGCTGCCTGGTC
AAGGACTACTTCCCCGAACCGGTGACGGTGTCGTGGAACTCAGGCGCCCTGACCAGCGGCGTGCAC
ACCTTCCCGGCTGTCCTACAGTCCTCAGGACTCTACTCCCTCAGCAGCGTGGTGACCGTGCCCTCCA
GCAGCTTGGGCACCCAGACCTACATCTGCAACGTGAATCACAAGCCCAGCAACACCAAGGTGGAC TABLE IIIa-continued Heavy Chain Variable and Constant Region Polynucleotide and Amino acid Sequences AAGAAAGTTGAGCCCAAATCTTGTGACAAAACTCACACATGCCCACCGTGCCCAGCACCTGAACTC
CTGGGGGGACCGTCAGTCTTCCTCTTCCCCCCAAAACCCAAGGACACCCTCATGATCTCCCGGACC
CCTGAGGTCACATGCGTGGTGGTGGACGTGAGCCACGAAGACCCTGAGGTCAAGTTCAACTGGTAC
GTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 639

QVQLVESGGGVVQPGRSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 640

4A2
CAGGTGCAGCTGCAGGAGTCGGGCCCAGGACTGGTGAAGCCTTCACAGACCCTGTCCCTCACCTGC
ACTGTCTCTGGTGGCTCCATCAGCAGTAGTGGTTACTACTGGAGCTGGATCCGCCAGCACCCAGGG
AAGGGCCTGGAGTGGATTGGGTACATCTATTACACTGGGAGCCCTACTACAACCCGTCCCTCAAG
AGTCGAGTTACCATATCAGTAGACACGTCTAAGAACCAGTTCTCCCTGAAGCTGAGCTCTGTGACT
GCCGCGGACACGGCCGTGTATTACTGTGCGAGAGATGGAAGCAGTGGCTGGTACTTCCAGTATTGG
GGCCAGGGCACCCTGGTCACCGTCTCTAGTGCCTCCACCAAGGGCCCATCGGTCTTCCCCCTGGCA
CCCTCCTCCAAGAGCACCTCTGGGGGCACAGCGGCCCTGGGCTGCCTGGTCAAGGACTACTTCCCC
GAACCGGTGACGGTGTCGTGGAACTCAGGCGCCCTGACCAGCGGCGTGCACACCTTCCCGGCTGTC
CTACAGTCCTCAGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 641

QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 642

4A9
CAGGTGCAGCTGCAGGAGTCGGGCCCAGGACTGGTGAAGCCTTCGGAGACCCTGTCCCTCACCTGC
ACTGTCTCTGGTGGCTCCATCAGTGGTTACTACTGGAGCTGGATCCGGCAGCCCCCAGGAAGGGA
CTGGAGTGGTTTGCATATTTCTCTTACAGTGGGAGCACCAACTACAACCCCTCCCTCAAGAGTCGA
GTCACCTTATCAGTAGACACGTCCAAGAACCAGTTCTCCCTGAAGCTGAGCTCTGTGACCGCTGCG
GACACGGCCGTGTATTACTGTGCGAGGAACTGGGCCTTCCACTTTGACTTCTGGGGCCAGGGAACC
CTGGTCACCGTCTCTAGTGCCTCCACCAAGGGCCCATCGGTCTTCCCCCTGGCACCCTCCTCCAAGA
GCACCTCTGGGGGCACAGCGGCCCTGGGCTGCCTGGTCAAGGACTACTTCCCCGAACCGGTGACGG
TGTCGTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCTCTTC
CCCCCAAAACCCAAGGACACCCTCATGATCTCCCGGACCCCTGAGGTCACATGCGTGGTGGTGGAC
GTGAGCCACGAAGACCCTGAGGTCAAGTTCAACTGGTACGTGGACGGCGTGGAGGTGCATAATGC
CAAGACAAAGCCGCGGGAGGAGCAGTACAACAGCACGTACCGTGTGGTCAGCGTCCTCACCGTCC
TGCACCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACACCCTGCC
CCCATCCCGGGAGGAGATGACCAAGAACCAGGTCAGCCTGACCTGCCTGGTCAAAGGCTTCTATCC
CAGCGACATCGCCGTGGAGTGGGAGAGCAATGGGCAGCCGGAGAACAACTACAAGACCACGCCTC
CCGTGCTGGACTCCGACGGCTCCTTCTTCCTCTATAGCAAGCTCACCGTGGACAAGAGCAGGTGGC

TABLE IIIa-continued

Heavy Chain Variable and Contant Region Polynucleotide
and Amino acid Sequences

AGCAGGGGAACGTCTTCTCATGCTCCGTGATGCATGAGGCTCTGCACAACCACTACACGCAGAAGA
GCCTCTCCCTGTCTCCGGGTAAATGA
SEQ ID NO: 643

QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 644

4B10
CAGGTGCAGCTGGTGGAGTCTGGGGGAGGCGTGGTCCAGCCTGGGAGGTCCCTGAGACTCTCCTGT
GCAGCCTCTGGATTCACCTTCAGTAGCTATGACATGCACTGGGTCCGCCAGGCTCCAGGCAAGGGG
CTGGAGTGGGTGGCAGTTATATCATATGATGGAACTAATGAATACTATGCAGACTCCGTGAAGGGC
CGATTCACCATCTCCAGAGACACTTCCAAGAACACGCTGTATTTGCAAATGAACAGCCTGAGAGCT
GAGGACACGGCTGTATATTACTGTGCGAGAGAACGATATTTTGACTGGTCTTTTGACTACTGGGGC
CAGGGAACCCTGGTCAGCGTCTCTAGTGCCTCCACCAAGGGCCCATCGGTCTTCCCCCTGGCACCC
TCCTCCAAGAGCACCTCTGGGGGCACAGCGGCCCTGGGCTGCCTGGTCAAGGACTACTTCCCCGAA
CCGGTGACGGTGTCGTGGAACTCAGGCGCCCTGACCAGCGGCGTGCACACCTTCCCGGCTGTCCTA
CAGTCCTCAGGACTCTACTCCCTCAGCAGCGTGGTGACCGTGCCCTCCAGCAGCTTGGGCACCCAG
ACCTACATCTGCAACGTGAATCACAAGCCCAGCAACACCAAGGTGGACAAGAAAGTTGAGCCCAA
ATCTTGTGACAAAACTCACACATGCCCACCGTGCCCAGCACCTGAACTCCTGGGGGGACCGTCAGT
CTTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGT
GCATAATGCCAAGACAAAGCCGCGGGAGGAGCAGTACAACAGCACGTACCGTGTGGTCAGCGTCC
TCACCGTCCTGCACCAGGACTGGCTGAATGGCAAGGAGTACAAGTGCAAGGTCTCCAACAAAGCC
CTCCCAGCCCCCATCGAGAAAACCATCTCCAAAGCCAAAGGGCAGCCCCGAGAACCACAGGTGTA
CACCCTGCCCCCATCCCGGGAGGAGATGACCAAGAACCAGGTCAGCCTGACCTGCCTGGTCAAAG
GCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTATAGCAAGCTCACCGTGGACAAG
AGCAGGTGGCAGCAGGGGAACGTCTTCTCATGCTCCGTGATGCATGAGGCTCTGCACAACCACTAC
ACGCAGAAGAGCCTCTCCCTGTCTCCGGGTAAATGA
SEQ ID NO: 645

QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 646

4F3
CAGGTGCAGCTGGTGGAGTCTGGGGGAGGCGTGGTCCAGCCTGGGAGGTCCCTGAGACTCTCCTGT
GCAGCGTCTGGATTCTCCTTCAGTAGCTATGACATGGACTGGGTCCGCCAGACTCCAGGCAAGGGG
CTGGAGTGGGTGGCAGTTATATGGTATGATGGAAGTAATAAATACTATGCAGACTCCGTGAGGGGC
CGATTCACCATCTCCAGAGACAATTCCAAGAACACGCTGTTTCTGCAAATGAACAGCCTGAGAGTC
GAGGACACGGCTGTGTATTACTGTGCGAGAGAAACTGGGGAGGGCTGGTACTTCGATCTCTGGGGC
CGTGGCACCCTGGTCACCGTCTCTAGTGCCTCCACCAAGGGCCCATCGGTCTTCCCCCTGGCACCCT
CCTCCAAGAGCACCTCTGGGGGCACAGCGGCCCTGGGCTGCCTGGTCAAGGACTACTTCCCCGAAC
CGGTGACGGTGTCGTGGAACTCAGGCGCCCTGACCAGCGGCGTGCACACCTTCCCGGCTGTCCTAC
AGTCCTCAGGACTCTACTCCCTCAGCAGCGTGGTGACCGTGCCCTCCAGCAGCTTGGGCACCCAGA
CCTACATCTGCAACGTGAATCACAAGCCCAGCAACACCAAGGTGGACAAGAAAGTTGAGCCCAAA
TCTTGTGACAAAACTCACACATGCCCACCGTGCCCAGCACCTGAACTCCTGGGGGGACCGTCAGTC
TTCCTCTTCCCCCCAAAACCCAAGGACACCCTCATGATCTCCCGGACCCCTGAGGTCACATGCGTG
GTGGTGGACGTGAGCCACGAAGACCCTGAGGTCAAGTTCAACTGGTACGTGGACGGCGTGGAGGT
GCATAATGCCAAGACAAAGCCGCGGGAGGAGCAGTACAACAGCACGTACCGTGTGGTCAGCGTCC
TCACCGTCCTGCACCAGGACTGGCTGAATGGCAAGGAGTACAAGTGCAAGGTCTCCAACAAAGCC
CTCCCAGCCCCCATCGAGAAAACCATCTCCAAAGCCAAAGGGCAGCCCCGAGAACCACAGGTGTA
CACCCTGCCCCCATCCCGGGAGGAGATGACCAAGAACCAGGTCAGCCTGACCTGCCTGGTCAAAG
GCTTCTATCCCAGCGACATCGCCGTGGAGTGGGAGAGCAATGGGCAGCCGGAGAACAACTACAAG
ACCACGCCTCCCGTGCTGGACTCCGACGGCTCCTTCTTCCTCTATAGCAAGCTCACCGTGGACAAG
AGCAGGTGGCAGCAGGGGAACGTCTTCTCATGCTCCGTGATGCATGAGGCTCTGCACAACCACTAC
ACGCAGAAGAGCCTCTCCCTGTCTCCGGGTAAATGA
SEQ ID NO: 647

QVQLVESGGGVVQPGRSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK

TABLE IIIa-continued

Heavy Chain Variable and Contant Region Polynucleotide
and Amino acid Sequences

GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 648

4F7
CAGGTGCAGCTGCAGGAGTCGGGCCCAGGACTGGTGAAGCCTTCGGAGACCCTGTCCCTCACCTGC
ACTGTCTCTGGTGGCTCCATCAGTAGTTACTCCTGGAGCTGGATCCGGCAGCCCCCAGGGAAGGGA
CTGGAGTGGATTGGGTATATCTATTACAGTGGGAGCACCAACTACAACCCCTCCCTCAAGAGTCGA
GTCACCATATCATTAGACACGTCCAAGAACCAGTTCTCCCTGAAGCTGAGCTCTGTGACCGCTGCG
GACACGGCCGTGTATTACTGTGCGAGGAACTGGGCCTTCCACTTTGACTACTGGGGCCAGGGAACC
CTGGTCACCGTCTCTAGTGCCTCCACCAAGGGCCCATCGGTCTTCCCCCTGGCACCCTCCTCCAAGA
GCACCTCTGGGGGCACAGCGGCCCTGGGCTGCCTGGTCAAGGACTACTTCCCCGAACCGGTGACGG
TGTCGTGGAACTCAGGCGCCCTGACCAGCGGCGTGCACACCTTCCCGGCTGTCCTACAGTCCTCAG
GACTCTACTCCCTCAGCAGCGTGGTGACCGTGCCCTCCAGCAGCTTGGGCACCCAGACCTACATCT
GCAACGTGAATCACAAGCCCAGCAACACCAAGGTGGACAAGAAAGTTGAGCCCAAATCTTGTGAC
AAAACTCACACATGCCCACCGTGCCCAGCACCTGAACTCCTGGGGGGACCGTCAGTCTTCCTCTTC
CCCCCAAAACCCAAGGACACCCTCATGATCTCCCGGACCCCTGAGGTCACATGCGTGGTGGTGGAC
GTGAGCCACGAAGACCCTGAGGTCAAGTTCAACTGGTACGTGGACGGCGTGGAGGTGCATAATGC
CAAGACAAAGCCGCGGGAGGAGCAGTACAACAGCACGTACCGTGTGGTCAGCGTCCTCACCGTCC
TGCACCAGGACTGGCTGAATGGCAAGGAGTACAAGTGCAAGGTCTCCAACAAAGCCCTCCCAGCC
CCCATCGAGAAAACCATCTCCAAAGCCAAAGGGCAGCCCCGAGAACCACAGGTGTACACCCTGCC
CCCATCCCGGGAGGAGATGACCAAGAACCAGGTCAGCTTGACCTGCCTGGTCAAAGGCTTCTATCC
CAGCGACATCGCCGTGGAGTGGGAGAGCAATGGGCAGCCGGAGAACAACTACAAGACCACGCCTC
CCGTGCTGGACTCCGACGGCTCCTTCTTCCTCTATAGCAAGCTCACCGTGGACAAGAGCAGGTGGC
AGCAGGGGAACGTCTTCTCATGCTCCGTGATGCATGAGGCTCTGCACAACCACTACACGCAGAAGA
GCCTCTCCCTGTCTCCGGGTAAATGA
SEQ ID NO: 649

QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 650

16A4
CAGGTGCAGCTGCAGGAGTCGGGCCCAGGACTGGCGAAGCCTTCGGAGACCCTGTCCCTCACCTGC
ACTGTCTCTGGTGACTCCATCACTAGTTACTACTGGAGCTGGATCCGGCAGCCCCCAGGGAAGGGA
CTGGAGTGGATTGGGTATATCTATTACAGCGGGAGCACCAATTACAACCCCTCCCTCAAGAGTCGA
GTCACCATATCAGTAGACACGTCCAAGAACCAGTTCTCCCTGAAGCTGAGTTCTGTGACCGCTGCG
GACACGGCCGTGTATTACTGTGCGAGAGATCAAAGGCGGATAGCAGCGGTGTACCCACTTCTAC
GGTATGGACGTCTGGGGCCAAGGGACCACGGTCACTGTCTCCTCAGCTTCCACCAAGGGCCCATCC
GTCTTCCCCCTGGCGCCCTCCTCCAAGAGCACCTCTGGGGGCACAGCGGCCCTGGGCTGCCTGGTC
AAGGACTACTTCCCCGAACCGGTGACGGTGTCGTGGAACTCAGGGGCCCTGACCAGCGGCGTGCA
CACCTTCCCGGCTGTCCTACAGTCCTCAGGACTCTACTCCCTCAGCAGCGTGGTGACCGTGCCCTCC
AGCAGCTTGGGCACCCAGACCTACATCTGCAACGTGAATCACAAGCCCAGCAACACCAAGGTGGA
CAAGAAAGTTGAGCCCAAATCTTGTGACAAAACTCACACATGCCCACCGTGCCCAGCACCTGAACT
CCTGGGGGGACCGTCAGTCTTCCTCTTCCCCCCAAAACCCAAGGACACCCTCATGATCTCCCGGAC
CCCTGAGGTCACATGCGTGGTGGTGGACGTGAGCCACGAAGACCCTGAGGTCAAGTTCAACTGGTA
CGTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCT
GACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 651

QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 652

16C1
CAGGTGCAGCTGCAGGAGTCGGGCCCAGGACTGGTGAAGCCTTCGGAGACCCTGTCCCTCACTTGT
ACTGTCTCTGGTGGCTCCATCAGTGGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGA
GTCACCATGTCAATAGACACGTCCAAGAACCAGTTCTCCCTGACGCTGAGCTCTTTGACCGCTGCG
GACACGGCCGTGTATTTCTGTGCGAGAGATGGGAGCAGTGGCTGGTACCGGTGGTTCGACCCCTGG
GGCCAGGGAACCCTGGTCACCGTCTCCTCAGCTTCCACCAAGGGCCCATCCGTCTTCCCCCTGGCG

TABLE IIIa-continued

Heavy Chain Variable and Contant Region Polynucleotide
and Amino acid Sequences

CCCTCCTCCAAGAGCACCTCTGGGGGCACAGCGGCCCTGGGCTGCCTGGTCAAGGACTACTTCCCC
GAACCGGTGACGGTGTCGTGGAACTCAGGGGCCCTGACCAGCGGCGTGCACACCTTCCCGGCTGTC
CTACAGTCCTCAGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 653

QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 654

17H8
CAGGTGCAGCTGCAGGAGTCGGGCCCAGGACTGGTGAAGCCTTCGGAGACCCTGTCCCTCACGTGC
ACTGTCTCTGGTGGCTCCATCAATAGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGC
GTCACCATATCAGTAGACACGTCCAAGAACCAGTTCTCCCTGAAGCTGAGCTCTGTGACCGCTGCG
GACACGGCCCTGTATTACTGTGCGAGAGATTCCCGGTATAGAAGTGGCTGGTACGATGCTTTTGAT
ATCTGGGGCCAAGGGACAATGGTCACCGTCTCTTCAGCTTCCACCAAGGGCCCATCCGTCTTCCCC
CTGGCGCCCTCCTCCAAGAGCACCTCTGGGGGCACAGCGGCCCTGGGCTGCCTGGTCAAGGACTAC
TTCCCCGAACCGGTGACGGTGTCGTGGAACTCAGGGGCCCTGACCAGCGGCGTGCACACCTTCCCG
GCTGTCCTACAGTCCTCAGGACTCTACTCCCTCAGCAGCGTGGTGACCGTGCCCTCCAGCAGCTTGG
GCACCCAGACCTACATCTGCAACGTGAATCACAAGCCCAGCAACACCAAGGTGGACAAGAAAGTT
GAGCCCAAATCTTGTGACAAAACTCACACATGCCCACCGTGCCCAGCACCTGAACTCCTGGGGGGA
CCGTCAGTCTTCCTCTTCCCCCCAAAACCCAAGGACACCCTCATGATCTCCCGGACCCCTGAGGTCA
CATGCGTGGTGGTGGACGTGAGCCACGAAGACCCTGAGGTCAAGTTCAACTGGTACGTGGACGGC
GTGGAGGTGCATAATGCCAAGACAAAGCCGCGGGAGGAGCAGTACAACAGCACGTACCGTGTGGT
CAGCGTCCTCACCGTCCTGCACCAGGACTGGCTGAATGGCAAGGAGTACAAGTGCAAGGTCTCCAA
CAAAGCCCTCCCAGCCCCCATCGAGAAAACCATCTCCAAAGCCAAAGGGCAGCCCCGAGAACCAC
AGGTGTACACCCTGCCCCCATCCCGGGAGGAGATGACCAAGAACCAGGTCAGCCTGACCTGCCTG
GTCAAAGGCTTCTATCCCAGCGACATCGCCGTGGAGTGGGAGAGCAATGGGCAGCCGGAGAACAA
CTACAAGACCACGCCTCCCGTGCTGGACTCCGACGGCTCCTTCTTCCTCTATAGCAAGCTCACCGTG
GACAAGAGCAGGTGGCAGCAGGGGAACGTCTTCTCATGCTCCGTGATGCATGAGGCTCTGCACAA
CCACTACACGCAGAAGAGCCTCTCCCTGTCTCCGGGTAAATGA
SEQ ID NO: 655

QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 656

19B5
CAGGTGCAGTTGGTGCAGTCTGGGGCTGAGGTGAAGAAGCCTGGGGCCTCAGTGAAGGTTTCCTGC
AAGGTTTCTGGATACACCTTCACCAGCTACTTTATTCACTGGGTGCGCCAGGCCCCTGGACAAGGG
CTTGAATGGATGGGAATTATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGATACAGCTATGGTTACATTTGGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA

TABLE IIIa-continued

Heavy Chain Variable and Contant Region Polynucleotide
and Amino acid Sequences

AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 657

QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 658

20D3
CAGGTGCAGCTGGTGCAGTCTGGGGCTGAGGTGAAGAAGCCTGGGGCCTCAGTGAAGGTTTCCTGC
AAGGTTTCTGGATACACCTTCACCAGCTACTTTATTCACTGGGTGCGCCAGGCCCCTGGACAAGGG
CTTGAGTGGATGGGAATAATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGGATACAGCTATGGTTACATTTTGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 659

QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 660

22D1
CAGGTGCAGCTGGTGCAGTCTGGGGCTGAGGTGAAGAAGCCTGGGGCCTCAGTGAGGGTTTCCTGC
AAGGTTTCTGGATACACCTTCACCAGCTACTTTATTCACTGGGTACGCCAGGCCCCTGGACAAGGG
CTTGAGTGGATGGGAATAATCAACCCTATTAGTGTTAGCACAAGCTACGCACAGAAGTTCCAGGGC
AGAGTCACCATGACCAGGGACACGTCCACGAGCACAGTCTTCATGGAGCTGAGCAGCCTGAGATC
TGAGGACACGGCCGTGTATTACTGTGCGCGAGGGGGGATACAGCTATGGTTACATTTGGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 661

QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK

TABLE IIIa-continued

Heavy Chain Variable and Contant Region Polynucleotide
and Amino acid Sequences

GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 662

22G10
GAGGTGCAACTGTTGGAGTCTGGGGGAGGCTTGGTACAGCCTGGGGGGTCCCTGAGACTCTCCTGT
GCAGCCTCTGGATTCACCTTTAGCAGTTATGCCATGAACTGGGTCCGCCAGGCTCCAGGGAAGGGG
CTGGAGTGGGTCTCAACTATTAGTGGTGGTGGTGCTAACACATACTACGCAGACTCCGTGAAGGGC
CGGTTCACCATCTCCAGTGACAATTCCAAGAGCACGCTGTATCTGCAAATGAACAGCCTGAGAGCC
GCGGACACGGCCGTATATCACTGTGCGAAAGGGGGAATGGGGGGATACTACTACGGTATGGACGT
CTGGGGCCAAGGGACCACGGTCACCGTCTCCTCAGCTTCCACCAAGGGCCCATCCGTCTTCCCCCT
GGCGCCCTCCTCCAAGAGCACCTCTGGGGGCACAGCGGCCCTGGGCTGCCTGGTCAAGGACTACTT
CCCCGAACCGGTGACGGTGTCGTGGAACTCAGGGGCCCTGACCAGCGGCGTGCACACCTTCCCGGC
TGTCCTACAGTCCTCAGGACTCTACTCCCTCAGCAGCGTGGTGACCGTGCCCTCCAGCAGCTTGGGC
ACCCAGACCTACATCTGCAACGTGAATCACAAGCCCAGCAACACCAAGGTGGACAAGAAAGTTGA
GCCCAAATCTTGTGACAAAACTCACACATGCCCACCGTGCCCAGCACCTGAACTCCTGGGGGGACC
GTCAGTCTTCCTCTTCCCCCCAAAACCCAAGGACACCCTCATGATCTCCCGGACCCCTGAGGTCACA
TGCGTGGTGGTGGACGTGAGCCACGAAGACCCTGAGGTCAAGTTCAACTGGTACGTGGACGGCGT
GGAGGTGCATAATGCCAAGACAAAGCCGCGGGAGGAGCAGTACAACAGCACGTACCGTGTGGTCA
GCGTCCTCACCGTCCTGCACCAGGACTGGCTGAATGGCAAGGAGTACAAGTGCAAGGTCTCCAACA
AAGCCCTCCCAGCCCCCATCGAGAAAACCATCTCCAAAGCCAAAGGGCAGCCCCGAGAACCACAG
GTGTACACCCTGCCCCCATCCCGGGAGGAGATGACCAAGAACCAGGTCAGCCTGACCTGCCTGGTC
AAAGGCTTCTATCCCAGCGACATCGCCGTGGAGTGGGAGAGCAATGGGCAGCCGGAGAACAACTA
CAAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 663

EVQLLESGGGLVQPGGSLRLSCAASGFTFSSYAMNWVRQAPGKGLEWVSTISGGGANTYYADSVKGR
FTISSDNSKSTLYLQMNSLRAADTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 664

23A10
CAGGTGCAGCTGGTGGAGTCTGGGGGAGGCGTGGTCCAGCCTGGGAGGTCCCTGAGACTCTCCTGT
GCAGCGTCTGGATTCACCTTCAGTCGCTATGGCATACACTGGGTCCGCCAGGCTCCAGGCAAGGGG
CTGGAGTGGGTGGCAGTTATATGGTATGATGGAAGTAATAAATACTATGCAGACTCCGTGAAGGGC
CGATTCACCATCTCCAGAGACAATTCCAAGAACACGCTGTATCTGCTAATGAACAGCCTGAGAGCC
GAGGACTCGGCTGTGTATTACTGTGCGAGAAGGGCCGGTATACCTGGAACTACGGCTACTACTAT
GGTATGGACGTCTGGGGCCAAGGGACCACGGTCACCGTCTCCTCAGCTTCCACCAAGGGCCCATCC
GTCTTCCCCCTGGCGCCCTCCTCCAAGAGCACCTCTGGGGGCACAGCGGCCCTGGGCTGCCTGGTC
AAGGACTACTTCCCCGAACCGGTGACGGTGTCGTGGAACTCAGGGGCCCTGACCAGCGGCGTGCA
CACCTTCCCGGCTGTCCTACAGTCCTCAGGACTCTACTCCCTCAGCAGCGTGGTGACCGTGCCCTCC
AGCAGCTTGGGCACCCAGACCTACATCTGCAACGTGAATCACAAGCCCAGCAACACCAAGGTGGA
CAAGAAAGTTGAGCCCAAATCTTGTGACAAAACTCACACATGCCCACCGTGCCCAGCACCTGAACT
CCTGGGGGGACCGTCAGTCTTCCTCTTCCCCCCAAAACCCAAGGACACCCTCATGATCTCCCGGAC
CCCTGAGGTCACATGCGTGGTGGTGGACGTGAGCCACGAAGACCCTGAGGTCAAGTTCAACTGGTA
CGTGGACGGCGTGGAGGTGCATAATGCCAAGACAAAGCCGCGGGAGGAGCAGTACAACAGCACGT
ACCGTGTGGTCAGCGTCCTCACCGTCCTGCACCAGGACTGGCTGAATGGCAAGGAGTACAAGTGCA
AGGTCTCCAACAAAGCCCTCCCAGCCCCCATCGAGAAAACCATCTCCAAAGCCAAAGGGCAGCCC
CGAGAACCACAGGTGTACACCCTGCCCCCATCCCGGGAGGAGATGACCAAGAACCAGGTCAGCCTG
ACCTGCCTGGTCAAAGGCTTCTATCCCAGCGACATCGCCGTGGAGTGGGAGAGCAATGGGCAGC
CGGAGAACAACTACAAGACCACGCCTCCCGTGCTGGACTCCGACGGCTCCTTCTTCCTCTATAGCA
AGCTCACCGTGGACAAGAGCAGGTGGCAGCAGGGGAACGTCTTCTCATGCTCCGTGATGCATGAG
GCTCTGCACAACCACTACACGCAGAAGAGCCTCTCCCTGTCTCCGGGTAAATGA
SEQ ID NO: 665

QVQLVESGGGVVQPGRSLRLSCAASGFTFSRYGIHWVRQAPGKGLEWVAVIWYDGSNKYYADSVKGR
FTISRDNSKNTLYLLMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 666

25F8
CAGGTGCAGCTGGTGCAGTCTGGGGCTGAGGTGAAGAAGCCTGGGGCCTCAGTGAAGGTTTCCTGC
AAGGCATCTGGATACACCTTCACCAGCTACTATATTCACTGGGTGCGCCAGGCCCCTGGACAAGGA
CTTGAGTGGATGGGAATAATCAACCCCAGTGGTGGTAGCACAAGGTACGCACAGAAGTTCCAGGG
CAGAGTCACCATGACCAGGGACACGTCCACGAGCACAGTCTTCATGGAGCTGAGCAGCCTGAGAT
CTGAGGACACGGCCGTGTATTACTGTGCGCGAGGGGGAATACAGCTATGGTTACATTTTGACTACT
GGGGCCAGGGAACCCTGGTCACCGTCTCCTCAGCTTCCACCAAGGGCCCATCCGTCTTCCCCCTGG

TABLE IIIa-continued

Heavy Chain Variable and Contant Region Polynucleotide and Amino acid Sequences

CGCCCTCCTCCAAGAGCACCTCTGGGGGCACAGCGGCCCTGGGCTGCCTGGTCAAGGACTACTTCC
CCGAACCGGTGACGGTGTCGTGGAACTCAGGGGCCCTGACCAGCGGCGTGCACACCTTCCCGGCTG
TCCTACAGTCCTCAGGACTCTACTCCCTCAGCAGCGTGGTGACCGTGCCCTCCAGCAGCTTGGGCA
CCCAGACCTACATCTGCAACGTGAATCACAAGCCCAGCAACACCAAGGTGGACAAGAAAGTTGAG
CCCAAATCTTGTGACAAAACTCACACATGCCCACCGTGCCCAGCACCTGAACTCCTGGGGGGACCG
TCAGTCTTCCTCTTCCCCCCAAAACCCAAGGACACCCTCATGATCTCCCGGACCCCTGAGGTCACAT
GCGTGGTGGTGGACGTGAGCCACGAAGACCCTGAGGTCAAGTTCAACTGGTACGTGGACGGCGTG
GAGGTGCATAATGCCAAGACAAAGCCGCGGGAGGAGCAGTACAACAGCACGTACCGTGTGGTCAG
CGTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 667

QVQLVQSGAEVKKPGASVKVSCKASGYTFTSYYTHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 668

25G10
CAGGTGCAGCTGCAGGAGTCGGGCCCAGGACTGGTGAAGCCTTCGGAGACCCTGTCCCTCACCTGC
ACTGTCTCTGGTGGCTCCATCAGTGGTTACTACTGGAGCTGGATCCGGCAGCCCCCAGGGAAGGGA
CTGGAGTGGATTGGGTATATCTATTACATTGGGAGCACCAACTACAACCCCTCCCTCAAGAGTCGA
GTCACCATGTCAGTAGACACGTCCAAGAACCAGTTCTCCCTGAAGCTGAGCTCTGTGACCGCTGCG
GACACGGCCGTGTATTACTGTGCGAGAGATGGGAGCAGTGGCTGGTACCGGTGGTTCGACCCCTGG
GGCCAGGGAACCCTGGTCACCGTCTCCTCAGCTTCCACCAAGGGCCCATCCGTCTTCCCCCTGGCG
CCCTCCTCCAAGAGCACCTCTGGGGGCACAGCGGCCCTGGGCTGCCTGGTCAAGGACTACTTCCCC
GAACCGGTGACGGTGTCGTGGAACTCAGGGGCCCTGACCAGCGGCGTGCACACCTTCCCGGCTGTC
CTACAGTCCTCAGGACTCTACTCCCTCAGCAGCGTGGTGACCGTGCCCTCCAGCAGCTTGGGCACC
CAGACCTACATCTGCAACGTGAATCACAAGCCCAGCAACACCAAGGTGGACAAGAAAGTTGAGCC
CAAATCTTGTGACAAAACTCACACATGCCCACCGTGCCCAGCACCTGAACTCCTGGGGGGACCGTC
AGTCTTCCTCTTCCCCCCAAAACCCAAGGACACCCTCATGATCTCCCGGACCCCTGAGGTCACATGC
GTGGTGGTGGACGTGAGCCACGAAGACCCTGAGGTCAAGTTCAACTGGTACGTGGACGGCGTGGA
GGTGCATAATGCCAAGACAAAGCCGCGGGAGGAGCAGTACAACAGCACGTACCGTGTGGTCAGCG
TCCTCACCGTCCTGCACCAGGACTGGCTGAATGGCAAGGAGTACAAGTGCAAGGTCTCCAACAAA
GCCCTCCCAGCCCCCATCGAGAAAACCATCTCCAAAGCCAAAGGGCAGCCCCGAGAACCACAGGT
GTACACCCTGCCCCCATCCCGGGAGGAGATGACCAAGAACCAGGTCAGCCTGACCTGCCTGGTCAA
AGGCTTCTATCCCAGCGACATCGCCGTGGAGTGGGAGAGCAATGGGCAGCCGGAGAACAACTACA
AGACCACGCCTCCCGTGCTGGACTCCGACGGCTCCTTCTTCCTCTATAGCAAGCTCACCGTGGACA
AGAGCAGGTGGCAGCAGGGGAACGTCTTCTCATGCTCCGTGATGCATGAGGCTCTGCACAACCACT
ACACGCAGAAGAGCCTCTCCCTGTCTCCGGGTAAATGA
SEQ ID NO: 669

QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPG
SEQ ID NO: 670

26D1
CAGGTGCAGTTGGTGCAGTCTGGGGCTGAGGTGAAGAAGCCTGGGGCCTCAGTGAAGGTTTCCTGT
AAGGCATCTAGATACACCTTCACCAGCTACTATATGTCCTGGGTGCGACAGGCCCCTGGACAAGGG
CTTGAGTGGATGGGAATAATCCACCCTAGTGGTGGTGACACAACCTACGCACAGAAGTTCCAGGGC
AGAGTCACCATGACCCGGGACACGTCCACGAGCACAGTCTACATGGAGCTGAGCAGCCTGAGATC
TGAGGACACGGCCGTGTATTACTGTGCGAGAGGGGGATAAAACTATGGTTACATTTTGACTATTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA

TABLE IIIa-continued

Heavy Chain Variable and Contant Region Polynucleotide and Amino acid Sequences

AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 671

QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 672

26F12
CAGGTGCAGTTGGTGCAGTCTGGGGCTGAGGTGAAGAAGCCTGGGGCCTCAGTGAAGGTTTCCTGC
AAGGCATCTAGATACACCTTCACCAACTACTATATGTCCTGGGTGCGACAGGCCCCTGGACAAGGG
CTTGAGTGGATGGGAATAATCAACCCTAGTGGTGGTGACTCAACCTACGCACAGAAGTTCCAGGGC
AGACTCACCATGACCGGGGACACGTCCACGAGCACAGTCTACATGGAGCTGAGCAGCCTGAGATC
TGAGGACACGGCCGTGTATTACTGTGCGAGAGGGGGGATACAACTATGGTTACATTTTGACTACTG
GGGCCAGGGAACCCTGGTCACCGTCTCCTCAGCTTCCACCAAGGGCCCATCCGTCTTCCCCCTGGC
GCCCTCCTCCAAGAGCACCTCTGGGGGCACAGCGGCCCTGGGCTGCCTGGTCAAGGACTACTTCCC
CGAACCGGTGACGGTGTCGTGGAACTCAGGGGCCCTGACCAGCGGCGTGCACACCTTCCCGGCTGT
CCTACAGTCCTCAGGACTCTACTCCCTCAGCAGCGTGGTGACCGTGCCCTCCAGCAGCTTGGGCAC
CCAGACCTACATCTGCAACGTGAATCACAAGCCCAGCAACACCAAGGTGGACAAGAAAGTTGAGC
CCAAATCTTGTGACAAAACTCACACATGCCCACCGTGCCCAGCACCTGAACTCCTGGGGGGACCGT
CAGTCTTCCTCTTCCCCCCAAAACCCAAGGACACCCTCATGATCTCCCGGACCCCTGAGGTCACATG
CGTGGTGGTGGACGTGAGCCACGAAGACCCTGAGGTCAAGTTCAACTGGTACGTGGACGGCGTGG
AGGTGCATAATGCCAAGACAAAGCCGCGGGAGGAGCAGTACAACAGCACGTACCGTGTGGTCAGC
GTCCTCACCGTCCTGCACCAGGACTGGCTGAATGGCAAGGAGTACAAGTGCAAGGTCTCCAACAA
AGCCCTCCCAGCCCCCATCGAGAAAACCATCTCCAAAGCCAAAGGGCAGCCCCGAGAACCACAGG
TGTACACCCTGCCCCCATCCCGGGAGGAGATGACCAAGAACCAGGTCAGCCTGACCTGCCTGGTCA
AAGGCTTCTATCCCAGCGACATCGCCGTGGAGTGGGAGAGCAATGGGCAGCCGGAGAACAACTAC
AAGACCACGCCTCCCGTGCTGGACTCCGACGGCTCCTTCTTCCTCTATAGCAAGCTCACCGTGGAC
AAGAGCAGGTGGCAGCAGGGGAACGTCTTCTCATGCTCCGTGATGCATGAGGCTCTGCACAACCAC
TACACGCAGAAGAGCCTCTCCCTGTCTCCGGGTAAATGA
SEQ ID NO: 673

QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 674

TABLE IIIb

Light Chain Variable and Contant Region Polynucleotide and Amino acid Sequences

2G6
TCCTATGAACTGACTCAGCCACCCTCAGTGTCCGTGTCCCCAGGACAGACAGCCAGCATCACCTGC
TCTGGAGATAGGTTGGGGGAAAAATATACTTGCTGGTATCAGCAGAGGCCAGGCCAGTCCCCTTTG
CTGGTCATCTATCAAGATACCAAGCGGCCCTCAGGGATCCCTGAGCGATTCTCTGGCTCCAACTCT
GGTAACACAGCCACTCTGACCATCAGCGGGACCCAGGCTGATGATGAGGCTGACTATTACTGTCAG
GCGTGGGACAGCAGCACTGTGGTATTCGGCGGAGGGACCAAGCTGACCGTCCTAGGTCAGCCCAA
GGCCAACCCCACTGTCACTCTGTTCCCGCCCTCCTCTGAGGAGCTCCAAGCCAACAAGGCCACACT
AGTGTGTCTGATCAGTGACTTCTACCCGGGAGCTGTGACAGTGGCCTGGAAGGCAGATGGCAGCCC
CGTCAAGGCGGGAGTGGAGACCACCAAACCCTCCAAACAGAGCAACAACAAGTACGCGGCCAGCA
GCTACCTGAGCCTGACGCCCGAGCAGTGGAAGTCCCACAGAAGCTACAGCTGCCAGGTCACGCAT
GAAGGGAGCACCGTGGAGAAGACAGTGGCCCCTACAGAATGTTCATGA
SEQ ID NO: 675

SYELTQPPSVSVSPGQTASITCSGDRLGEKYTCWYQQRPGQSPLLVIYQDTKRPSGIPERFSGSNSGNTAT
LTISGTQAMDEADYYCQAWDSSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 676

TABLE IIIb-continued

Light Chain Variable and Contant Region Polynucleotide
and Amino acid Sequences

4A2
GAAATTGTGTTGACGCAGTCTCCAGGCACCCTGTCTTTGTCTCCAGGGGAAAGAGCCACCCTCTCCT
GCAGGGCCAGTCGGAATATTAGCAGCAGCTACTTAGCCTGGTACCAGCAGAAACCTGGCCAGGCT
CCCAGGCTCCTCATCTATGGTCCATCCAGCAGGGCCACTGGCATCCCAGACAGGTTCAGTGGCAGT
GGGTCTGGGACAGACTTCACTCTCACCATCAGCAGACTGGAGCCTGAAGATTTTACAGTGTATTAC
TGTCAGCAGTATGGTAGCTCATTCACTTTCGGCCCTGGGACCAAAGTGGATATCAAACGTACGGTG
GCTGCACCATCTGTCTTCATCTTCCCGCCATCTGATGAGCAGTTGAAATCTGGAACTGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 677

EIVLTQSPGTLSLSPGERATLSCRASRNISSSYLAWYQQKPGQAPRLLIYGPSSRATGIPDRFSGSGSGTDF
TLTISRLEPEDFTVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 678

4A9
CAGTCTGTGCTGACGCAGCCGCCCTCAGTGTCTGGGGCCCCAGGACAGAGGGTCACCATCTCCTGC
ACTGGGAGCAGCTCCAACATCGGGACAGGTTATGCTGTACACTGGTACCAGCAGTTTCCAGGAACA
GCCCCCAAACTCCTCATCTATGGTAACAACAATCGGCCCTCAGGGGTTCCTGACCGATTCTCTGGCT
CCAAGTCTGGCACCTCAGCCTCCTGGCCATCACTGGGCTCCAGGCTGAGGATGAGGCTGATTATT
ACTGCCAGTCCTATGACAGCAGACTGAGTGGTTGGGTGTTCGGCGGAGGGACCAAGCTGACCGTCC
TAGGTCAGCCCAAGGCCAACCCCACTGTCACTCTGTTCCCGCCCTCCTCTGAGGAGCTCCAAGCCA
ACAAGGCCACACTAGTGTGTCTGATCAGTGACTTCTACCCGGGAGCTGTGACAGTGGCCTGGAAGG
CAGATGGCAGCCCCGTCAAGGCGGGAGTGGAGACCACCAAACCCTCCAAACAGAGCAACAACAAG
TACGCGGCCAGCAGCTACCTGAGCCTGACGCCCGAGCAGTGGAAGTCCCACAGAAGCTACAGCTG
CCAGGTCACGCATGAAGGGAGCACCGTGGAGAAGACAGTGGCCCCTACAGAATGTTCATGA
SEQ ID NO: 679

QSVLTQPPSVSGAPGQRVTISCTGSSSNIGTGYAVHWYQQFPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 680

4B10
GAAATTGTATTGACGCAGTCTCCAGGCACCCTGTCTTTGTCTCCAGGGGAAAGAGCCACCCTCTCCT
GCAGGGCCAGTCAGAGTGTTAGCAACACCTACTTAGCCTGGTACCATCAGAGACCTGGCCAGGCTC
CCAGGCTCCTCATCTATGGTCATCCAGCAGGGCCACTGGCATCCCAGACAGATTCAGTGGCAGTG
GGTCTGGGACAGACTTCGCTCTCACCATCAGCAGTCTGGAGCCTGAAGATTTTGCAGTGTATTACT
GTCAGCAGTACAGTAACTCGTGGACGTTCGGCCAAGGGACCAAGGTGGAAATCAAACGAACTGTG
GCTGCACCATCTGTCTTCATCTTCCCGCCATCTGATGAGCAGTTGAAATCTGGAACTGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 681

EIVLTQSPGTLSLSPGERATLSCRASQSVSNTYLAWYHQRPGQAPRLLIYGASSRATGIPDRFSGSGSGTD
FALTISSLEPEDFAVYYCQQYSNSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 682

4F3
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGCTACTTAGCCTGGTACCAGCAGAAACCTGGCCAGGCT
CCCAGGCTCCTCATCTATGGTGCATCCAGCAGGGCCACTGGCATCCCAGACAGGTTCAGTGGCAGT
GGGTCTGGGACAGACTTCACTCTCACCATCAGCAGACTGGAACCTGAGGATTTTGCAGTGTATTAC
TGTCAGCAGTATGGTAGCTCGTGGACGTTCGGCCAAGGGACCAAGGTGGAAATCAAACGTACGGT
GGCTGCACCATCTGTCTTCATCTTCCCGCCATCTGATGAGCAGTTGAAATCTGGAACTGCCTCTGTT
GTGTGCCTGCTGAATAACTTCTATCCCAGAGAGGCCAAAGTACAGTGGAAGGTGGATAACGCCCTC
CAATCGGGTAACTCCCAGGAGAGTGTCACAGAGCAGGACAGCAAGGACAGCACCTACAGCCTCAG
CAGCACCCTGACGCTGAGCAAAGCAGACTACGAGAAACACAAAGTCTACGCCTGCGAAGTCACCC
ATCAGGGCCTGAGCTCGCCCGTCACAAAGAGCTTCAACAGGGGAGAGTGTTGA
SEQ ID NO: 683

EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 684

TABLE IIIb-continued

Light Chain Variable and Contant Region Polynucleotide
and Amino acid Sequences

4F7
CAGTCTGTGCTGACGCAGCCGCCCTCAGTGTCTGGGGCCCCAGGGCAGAGGGTCACCATCTCCTGC
ACTGGGAGCAGCTCCAATATCGGGACAGGTTATGATGTACACTGGTATCAGCAGCTTCCAGGAACA
GCCCCCAAACTCCTCATCCATGGTAACAGCAATCGGCCCTCAGGGGTCCCTGACCGATTCTCTGGC
TCCAAGTCTGGCACCTCAGCCTCCCTGGCCATCACTGGGCTCCAGGCTGAGGATGAGGCTGATTAT
TACTGCCAGTCCTATGACAGCAGTCTGAGTGGTTGGGTGTTCGGCGGAGGGACCAGGTTGACCGTC
CTAGGTCAGCCCAAGGCCAACCCCACTGTCACTCTGTTCCCGCCCTCCTCTGAGGAGCTCCAAGCC
AACAAGGCCACACTAGTGTGTCTGATCAGTGACTTCTACCCGGGAGCTGTGACAGTGGCCTGGAAG
GCAGATGGCAGCCCCGTCAAGGCGGGAGTGGAGACCACCAAACCCTCCAAACAGAGCAACAACAA
GTACGCGGCCAGCAGCTACCTGAGCCTGACGCCCGAGCAGTGGAAGTCCCACAGAAGCTACAGCT
GCCAGGTCACGCATGAAGGGAGCACCGTGGAGAAGACAGTGGCCCCTACAGAATGTTCATGA
SEQ ID NO: 685

QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 686

16A4
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGTTATTTAGCCTGGTACCAGCAGAAACCTGGCCAGGCTC
CCAGGCTCCTCATCTATGGTACATCCAGCAGGGCCACTGGCATCCCAGACAGGTTCAGTGGCAGTG
GGTCTGGGACAGACTTCACTCTCACCATCAGCAGACTGGAGCCTGAAGATTTTGCAGTGTATTATT
GTCAGCAGTACGGTAGCTCACCTTTCACTTTCGGCGGAGGGACCAAGGTGGAGATCAAACGAACTG
TGGCTGCACCATCTGTCTTCATCTTCCCGCCATCTGATGAGCAGTTGAAATCTGGTACCGCCTCTGT
TGTGTGCCTGCTGAATAACTTCTATCCCAGAGAGGCCAAAGTACAGTGGAAGGTGGATAACGCCCT
CCAATCGGGTAACTCCCAGGAGAGTGTCACAGAGCAGGACAGCAAGGACAGCACCTACAGCCTCA
GCAGCACCCTGACGCTGAGCAAAGCAGACTACGAGAAACACAAAGTCTACGCCTGCGAAGTCACC
CATCAGGGCCTGAGCTCGCCCGTCACAAAGAGCTTCAACAGGGGAGAGTGTTGA
SEQ ID NO: 687

EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 688

16C1
GAAATTGTGTTGACGCAGTCTCCAGGCACCCTGTCTTTGTCTCCAGGGGAAAGAGCCACCCTCTCCT
GCAGGGCCAGCCAGAGTGTTAGCAGCAGCTACTTAGCCTGGTACCAGCAGAAACCTGGCCAGGCT
CCCAGGCTCCTCATCTTTGGTGCATCCAGCAGGGCCACTGGCATCCCAGACAGGTTCAGTGGCAGT
GGGTCTGGGACAGACTTCACTCTCACCATCAGCGGACTGGAGCCTGAAGATTTTGCAGTGTATCAC
TGTCAGCAGTATGGTAACTCACCGCTCACTTTCGGCGGAGGGACCAAGGTGGAGATCAAACGAACT
GTGGCTGCACCATCTGTCTTCATCTTCCCGCCATCTGATGAGCAGTTGAAATCTGGTACCGCCTCTG
TTGTGTGCCTGCTGAATAACTTCTATCCCAGAGAGGCCAAAGTACAGTGGAAGGTGGATAACGCCC
TCCAATCGGGTAACTCCCAGGAGAGTGTCACAGAGCAGGACAGCAAGGACAGCACCTACAGCCTC
AGCAGCACCCTGACGCTGAGCAAAGCAGACTACGAGAAACACAAAGTCTACGCCTGCGAAGTCAC
CCATCAGGGCCTGAGCTCGCCCGTCACAAAGAGCTTCAACAGGGGAGAGTGTTGA
SEQ ID NO: 689

EIVLTQSPGTLSLSPGERATLSCRASQSVSSSYLAWYQQKPGQAPRLLIFGASSRATGIPDRFSGSGSGTD
FTLTISGLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 690

17H8
GACATTGTATTGACGCAGTCTCCAGGCACCCTGTCTTTGTCTCCAGGGGAAAGAGCCACCCTCTCCT
GCAGGGCCAGTCAGAGTGTTGCCGGCAGCTACCTAGCCTGGTACCAGCAGAAACCTGGCCAGGCT
CCCAGGCTCCTCATCTCTGGTGCATCCAGCAGGGCCACTGGCATCCCAGACAGGTTCAGTGGCAGT
GGGTCTGGGACAGACTTCACTCTCACCATCAGCAGACTGGAGCCTGAAGATTTTGCAGTGTATTAC
TGTCAGCAGTATGGTAAATCACCGATCACCTTCGGCCAAGGGACACGACTGGAGATGAAAGGAAC
TGTGGCTGCACCATCTGTCTTCATCTTCCCGCCATCTGATGAGCAGTTGAAATCTGGTACCGCCTCT
GTTGTGTGCCTGCTGAATAACTTCTATCCCAGAGAGGCCAAAGTACAGTGGAAGGTGGATAACGCC
CTCCAATCGGGTAACTCCCAGGAGAGTGTCACAGAGCAGGACAGCAAGGACAGCACCTACAGCCT
CAGCAGCACCCTGACGCTGAGCAAAGCAGACTACGAGAAACACAAAGTCTACGCCTGCGAAGTCA
CCCATCAGGGCCTGAGCTCGCCCGTCACAAAGAGCTTCAACAGGGGAGAGTGTTGA
SEQ ID NO: 691

DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKGTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 692

TABLE IIIb-continued

Light Chain Variable and Contant Region Polynucleotide
and Amino acid Sequences

19B5
CAGTCTGCGCTGACTCAGCCACCCTCAACGACTGGGACCCCCGGGCAGAGGGTCACCATCTCTTGT
TCTGGAAGCAGGTCCAACATCGGAAGCAATTTTGTAAACTGGTACAAGCAGCTCCCAGGAACGGC
CCCCAAAGTCCTCATCTATACTAATAATCAGCGGCCCTCAGGGTCCCTGACCGATTCTCTGGCTCC
AAGTCTGGCACCTCAGCCTCCCTGGCCATCAGTGGGCTCCAGTCTGAGGATGAGTCTGATTATTACT
GCGCAACATGGGATGACAGTATGAATGGTTGGGTGTTCGGCGGAGGGACCAAACTGACCGTCCTA
GGTCAGCCCAAGGCTGCCCCTCGGTCACTCTGTTCCCACCCTCCTCTGAGGAGCTTCAAGCCAAC
AAGGCCACACTGGTGTGTCTCATAAGTGACTTCTACCCGGGAGCCGTGACAGTGGCCTGGAAGGCA
GATAGCAGCCCCGTCAAGGCGGGAGTGGAGACCACCACACCCTCCAAACAAAGCAACAACAAGTA
CGCGGCCAGCAGCTATCTGAGCCTGACGCCTGAGCAGTGGAAGTCCCACAGAAGCTACAGCTGCC
AGGTCACGCATGAAGGGAGCACCGTGGAGAAGACAGTGGCCCCTACAGAATGTTCATGA
SEQ ID NO: 693

QSALTQPPSTTGTPGQRVTISCSGSRSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 694

20D3
CAGTCTGCGCTGACTCAGCCACCCTCAGCGACTGGGACCCCCGGGCAGAGGGTCACCATCTCTTGT
TCTGGAAGCAGCTCCAACATCGGAAGCAATTTTGTAAACTGGTACAAGCAGCTCCCAGGAACGGCC
CCCAAAGTCCTCATCTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAACATGGGATGACAGCCTGAATGGTTGGGTGTTCGGCGGAGGGACCAAGCTGACCGTCCTAG
GTCAGCCCAAGGCTGCCCCTCGGTCACTCTGTTCCCACCCTCCTCTGAGGAGCTTCAAGCCAACA
AGGCCACACTGGTGTGTCTCATAAGTGACTTCTACCCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 695

QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 696

22D1
CAGTCTGCGCTGACTCAGCCACCCTCAGCGACTGGGACCCCCGGGCAGAGGGTCACCATCTCTTGT
TCTGGAAGCAGCTCCAACATCGGAAGCAATTTTGTAAACTGGTACAAGCAGCTCCCAGGAACGGCC
CCCAAAGTCCTCATCTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAACATGGGATGACAGTATGAATGGTTGGGTGTTCGGCGGAGGGACCAAGCTGACCGTCCTAG
GTCAGCCCAAGGCTGCCCCTCGGTCACTCTGTTCCCACCCTCCTCTGAGGAGCTTCAAGCCAACA
AGGCCACACTGGTGTGTCTCATAAGTGACTTCTACCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 697

QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 698

22G10
GAAATAGTGATGACGCAGTCTCCAGTCACCCTGTCTCTGTCTCTAGGGGAAAGAGCCACCCTCTCC
TGCAGGGCCAGTCAGAGTATTAGCAGCAACTTAGCCTGGTTCCAGCAGAAACCTGGCCAGGCTCCC
AGACTCCTCATCTATGGTGCATTTACCAGGGCCACTGGTATCCCAGCCAGGGTCAGTGGCAGTGGG
TCTGGGACAGAGTTCACTCTCACCATCAGCAGCCTGCAGTCTGAAGATTTTGCAGTTTATTACTGTC
AGCAGTATAATTACTGGCCGCTCACTTTCGGCGGAGGGACCAAGGTGGAGATCAAGCGAACTGTG
GCTGCACCATCTGTCTTCATCTTCCCGCCATCTGATGAGCAGTTGAAATCTGGTACCGCCTCTGTTG
TGTGCCTGCTGAATAACTTCTATCCCAGAGAGGCCAAAGTACAGTGGAAGGTGGATAACGCCCTCC
AATCGGGTAACTCCCAGGAGAGTGTCACAGAGCAGGACAGCAAGGACAGCACCTACAGCCTCAGC
AGCACCCTGACGCTGAGCAAAGCAGACTACGAGAAACACAAAGTCTACGCCTGCGAAGTCACCCA
TCAGGGCCTGAGCTCGCCCGTCACAAAGAGCTTCAACAGGGGAGAGTGTTGA
SEQ ID NO: 699

EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 700

TABLE IIIb-continued

Light Chain Variable and Contant Region Polynucleotide
and Amino acid Sequences

23A10
TCCTATGAGCTGACTCAGCCACCCTCAGTGTCCGTGTCCCCAGGACAGACAGCCAGCATCACCTGC
TCTGGAGATAGATTGGGGGAGAAATATGTTTGCTGGTATCAGCAGAAGCCAGGCCAGTCCCCTATA
CTGGTCATCTATCAAGATAATAAGTGGCCCTCAGGGATCCCTGAGCGATTCTCTGGCTCCAACTCTG
GGAACACAGCCACTCTGACCATCAGCGGGACCCAGGCTATGGATGAGGCTGACTATTACTGTCAGG
CGTGGGACAGCAGCACTGTGGTATTCGGCGGGGGGACCAAGCTGACCGTCCTAGGTCAGCCCAAG
GCTGCCCCCTCGGTCACTCTGTTCCCACCCTCCTCTGAGGAGCTTCAAGCCAACAAGGCCACACTG
GTGTGTCTCATAAGTGACTTCTACCCGGGAGCCGTGACAGTGGCCTGGAAGGCAGATAGCAGCCCC
GTCAAGGCGGGAGTGGAGACCACCACACCCTCCAAACAAAGCAACAACAAGTACGCGGCCAGCAG
CTATCTGAGCCTGACGCCTGAGCAGTGGAAGTCCCACAGAAGCTACAGCTGCCAGGTCACGCATGA
AGGGAGCACCGTGGAGAAGACAGTGGCCCCTACAGAATGTTCATGA
SEQ ID NO: 701

SYELTQPPSVSVSPGQTASITCSGDRLGEKYVCWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 702

25F8
CAGTCTGCGCTGACTCAGCCACCCTCAGCGACTGGGACCCCCGGGCAGAGGGTCACCATCTCTTGT
TCTGGAAGCAGCTCCAACATCGGAAGGAATTTTGTAAACTGGTATAAGCAGCTCCCAGGAACGGCC
CCCAAAGTCCTCATTTATACTAATAATCAGCGGCCCTCAGGGGTCCCTGACCGATTCTCTGGCTCCA
AGTCTGGCACCTCAGCCTCCCTGGCCATCAGTGGGCTCCAGTCTGAGGATGAGTCTGATTATTACTG
TGCAGCATGGGATGACAGCCTGAATGGTTGGGTGTTCGGCGGAGGGACCAAGCTGACCGTCCTAG
GTCAGCCCAAGGCTGCCCCCTCGGTCACTCTGTTCCCACCCTCCTCTGAGGAGCTTCAAGCCAACA
AGGCCACACTGGTGTGTCTCATAAGTGACTTCTACCCGGGAGCCGTGACAGTGGCCTGGAAGGCAG
ATAGCAGCCCCGTCAAGGCGGGAGTGGAGACCACCACACCCTCCAAACAAAGCAACAACAAGTAC
GCGGCCAGCAGCTATCTGAGCCTGACGCCTGAGCAGTGGAAGTCCCACAGAAGCTACAGCTGCCA
GGTCACGCATGAAGGGAGCACCGTGGAGAAGACAGTGGCCCCTACAGAATGTTCATGA
SEQ ID NO: 703

QSALTQPPSATGTPGQRVTISCSGSSSNIGRNFVNWYKQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 704

25G10
GAAATTGTGTTGACGCAGTCTCCAGGCACCCTGTCTTTGTCTCCAGGGGAAAGAGCCACCCTCTCCT
GCAGGGCCAGTCAGAGTGTTAGCAGCAGCTACTTAGCCTGGTACCAGCAGAAACCTGGCCAGGCT
CCCAGGCTCCTCATCTTTGGTGCATCCAGCAGGGCCACTGGCATCCCAGACAGGTTCAGTGGCAGT
GGGTCTGGGACAGACTTCACTCTCACCATCAGCAGACTGGAGCCTGAAGATTTTGCAGTGTATCAC
TGTCAGCAGTATGGTAACTCACCGCTCACTTTCGGCGGAGGGACCAAGGTGGAGATCAAACGAACT
GTGGCTGCACCATCTGTCTTCATCTTCCCGCCATCTGATGAGCAGTTGAAATCTGGAACTGCCTCTG
TTGTGTGCCTGCTGAATAACTTCTATCCCAGAGAGGCCAAAGTACAGTGGAAGGTGGATAACGCCC
TCCAATCGGGTAACTCCCAGGAGAGTGTCACAGAGCAGGACAGCAAGGACAGCACCTACAGCCTC
AGCAGCACCCTGACGCTGAGCAAAGCAGACTACGAGAAACACAAAGTCTACGCCTGCGAAGTCAC
CCATCAGGGCCTGAGCTCGCCCGTCACAAAGAGCTTCAACAGGGGAGAGTGTTGA
SEQ ID NO: 705

EIVLTQSPGTLSLSPGERATLSCRASQSVSSSYLAWYQQKPGQAPRLLIFGASSRATGIPDRFSGSGSGTD
FTLTISRLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 706

26D1
CACTCTGTGCTGACTCAGTCACCCTCAGCGTCTGGGACCCCCGGACAGAGGGTCACCATCTCTTGTT
CTGGAAGCCGCTCCAACATCGGAAGTAATTTTGTAAACTGGTACCAGCAGCTCCCAGGAACGGCCC
CCAAACTCCTCATCTATACTAATAATCAGCGGCCCTCAGGGGTCCCTGACCGATTCTCTGGCTCCAA
GTCTGGCACCTCAGCCTCCCTGGCCATCAGTGGGCTCCAGTCTGAGGATGAGGCTGATTATTACTGT
GCAGTATGGGATGACAGCCTGAATGGTTGGGTGTTCGGCGGAGGGACCAAGCTGACCGTCCTAGG
TCAGCCCAAGGCTGCCCCCTCGGTCACTCTGTTCCCACCCTCCTCTGAGGAGCTTCAAGCCAACAA
GGCCACACTGGTGTGTCTCATAAGTGACTTCTACCCGGGAGCCGTGACAGTGGCCTGGAAGGCAGA
TAGCAGCCCCGTCAAGGCGGGAGTGGAGACCACCACACCCTCCAAACAAAGCAACAACAAGTACG
CGGCCAGCAGCTATCTGAGCCTGACGCCTGAGCAGTGGAAGTCCCACAGAAGCTACAGCTGCCAG
GTCACGCATGAAGGGAGCACCGTGGAGAAGACAGTGGCCCCTACAGAATGTTCATGA
SEQ ID NO: 707

HSVLTQSPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 708

TABLE IIIb-continued

Light Chain Variable and Contant Region Polynucleotide
and Amino acid Sequences

26F12
CAGTCTGTGCTGACTCAGTCACCCTCAGCGTCTGGGACCCCCGGGCAGAAGGTCACCATCTCTTGTT
CTGGAAGCCGCTCCAACATCGGAAGTAATTTTGTAAACTGGTACCAGCAGCTCCCAGGAACGGCCC
CCAAACTCCTCATCTATACTAATTATCAGCGGCCCTCAGGGGTCCCTGACCGATTCTCTGGCTCCAA
GTCTGGCACCTCAGCCTCCCTGGCCATCAGTGGGCTCCAGTCTGAGGATGAGGCTGATTATTACTGT
GCAGTATGGGATGACAGCCTGAATGGTTGGGTGTTCGGCGGAGGGACCAAGCTGACCGTCCTAGG
TCAGCCCAAGGCTGCCCCCTCGGTCACTCTGTTCCCACCCTCCTCTGAGGAGCTTCAAGCCAACAA
GGCCACACTGGTGTGTCTCATAAGTGACTTCTACCCGGGAGCCGTGACAGTGGCCTGGAAGGCAGA
TAGCAGCCCCGTCAAGGCGGGAGTGGAGACCACCACACCCTCCAAACAAAGCAACAACAAGTACG
CGGCCAGCAGCTATCTGAGCCTGACGCCTGAGCAGTGGAAGTCCCACAGAAGCTACAGCTGCCAG
GTCACGCATGAAGGGAGCACCGTGGAGAAGACAGTGGCCCCTACAGAATGTTCATGA
SEQ ID NO: 709

QSVLTQSPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 710

TABLE IIIc

Heavy Chain Variable and Contant Region Polynucleotide
and Amino acid Sequences

13586_HC [hu anti-<huCDH19> 4F3 VH]::huIgG1z
QVQLVESGGGVVQPGRSLRLSCAASGFSFSSYDMDWVRQTPGKGLEWVAVIWYDGSNKYYADSVRG
RFTISRDNSKNTLFLQMNSLRVEDTAVYYCARETGEGWVFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 711

13589_HC [hu anti-<huCDH19> 4A9 VH]::huIgG1z
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAPHFDFWQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 712

13590_HC [hu anti-<huCDH19> 4B10 VH]::huIgG1z
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 713

13874_HC [hu anti-<huCDH19> 17H8.2 VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 714

13875_HC [hu anti-<huCDH19> 16C1.1 VH]::huIgG1z
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 715

TABLE IIIc-continued

Heavy Chain Variable and Contant Region Polynucleotide
and Amino acid Sequences

13876_HC [hu anti-<huCDH19> 16A4.1 VH]::huIgG1z
QVQLQESGPGLAKPSETLSLTCTVSGDSITSYYWSWIRQPPGKGLEWIGYIYYSGSTNYNPSLKSRVTISV
DTSKNQFSLKLSSVTAADTAVYYCARDQRRIAAAGTHFYGMDVWGQGTTVTSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 716

13877_HC [hu anti-<huCDH19> 22G10.1 VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAADTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 717

13878_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 718

13879_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 719

13880_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 720

13881_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 721

13882_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 722

13883_HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG TABLE IIIc-continued Heavy Chain Variable and Contant Region Polynucleotide
and Amino acid Sequences

```
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 723

13885_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 724

14022_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 725

14024_HC [hu anti-<huCDH19> 4A2 (1-472)(Q17E,H47P) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 726

14025_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 727

14026_HC [hu anti-<huCDH19> 4A2 (1-472)(Q17E,H47P) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCARDGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 728

14027_HC [hu anti-<huCDH19> 4A2 (1-472)(Q17E,H47P,D111E) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGWYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 729

14028_HC [hu anti-<huCDH19> 4A2 (1-472)(Q17E,H47P,D111E,W134Y) VH]::huIgG1z
QVQLQESGPGLVKPSETLSLTCTVSGGSISSSGYYWSWIRQPPGKGLEWIGYIYYTGSAYYNPSLKSRVT
ISVDTSKNQFSLKLSSVTAADTAVYYCAREGSSGYYFQYWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 730

14029_HC [hu anti-<huCDH19> 4A2 VH]::huIgG1z
QVQLQESGPGLVKPSQTLSLTCTVSGGSISSSGYYWSWIRQHPGKGLEWIGYIYYTGSAYYNPSLKSRV
TISVDTSKNQFSLKLSSVTAADTAVYYCARDGSSGWYFQYWGQGTLVTVSSASTKGPSVFPLAPSSKST
```

TABLE IIIc-continued

Heavy Chain Variable and Contant Region Polynucleotide
and Amino acid Sequences

SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 731

14030_HC [hu anti-<huCDH19> 4F3 (1-471)(R17G) VH]::huIgG1z
QVQLVESGGGVVQPGGSLRLSCAASGFSFSSYDMDWVRQTPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 732

14031_HC [hu anti-<huCDH19> 4F3 (1-471)(R17G,T47A) VH]::huIgG1z
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGRGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 733

14032_HC [hu anti-<huCDH19> 4F3 (1-471)(R17G,T47A,R141Q) VH]::huIgG1z
QVQLVESGGGVVQPGGSLRLSCAASGFSFSSYDMDWVRQAPGKGLEWVAVIWYDGSNKYYADSVRG
RFTISRDNSKNTLFLQMNSLRVEDTAVYYCARETGEGWYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 734

14033_HC [hu anti-<huCDH19> 4F3 (1-471)(R17G,T47A,D61E,D72E,R141Q) VH]::huIgG1z
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGWYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 735

14034_HC [hu anti-<huCDH19> 4F3 (1-471)
(R17G,T47A,D61E,D72E,W134Y,R141Q) VH]::huIgG1z
QVQLVESGGGVVQPGGSLRLSCAASGFSFSSYDMDWVRQAPGKGLEWVAVIWYEGSNKYYAESVRG
RFTISRDNSKNTLFLQMNSLRVEDTAVYYCARETGEGYYFDLWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 736

14039_HC [hu anti-<huCDH19> 2G6 (1-477)(R17G,D61E,D72E,K94N) VH]::huIgG1z
QVQLVESGGGVVQPGGSLRLSCAASGFTFSSYGMHWVRQAPGKGLEWVAFIWYEGSNKYYAESVKD
RFTISRDNSKNTLYLQMNSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 737

14040_HC [hu anti-<huCDH19> 16C1.1 VH]::huIgG1z
QVQLQESGPGLVKPSETLSLTCTVSGGSISGYYWSWIRQPPGKGLEWIGYIYYIGSTNYNPSLKSRVTMS
IDTSKNQFSLTLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 738

TABLE IIIc-continued

Heavy Chain Variable and Contant Region Polynucleotide
and Amino acid Sequences

14041_HC [hu anti-<huCDH19> 16C1.1 (1-469)(T92K) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 739

14042_HC [hu anti-<huCDH19> 16C1.1 (1-469)(T92K,D109E) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCAREGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 740

14043_HC [hu anti-<huCDH19> 16C1.1 (1-469)(T92K,W132Y,W135Y) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGYYRYFDPWGQGTLVTVSSASTKGPSVFPLAPSSKSTSG
GTAALGCLVKDYFPEPVTVSWNSGALTSGVHTFPAVLQSSGLYSLSSVVTVPSSSLGTQTYICNVNHKP
SNTKVDKKVEPKSCDKTHTCPPCPAPELLGGPSVFLFPPKPKDTLMISRTPEVTCVVVDVSHEDPEVKFN
WYVDGVEVHNAKTKPREEQYNSTYRVVSVLTVLHQDWLNGKEYKCKVSNKALPAPIEKTISKAKGQP
REPQVYTLPPSREEMTKNQVSLTCLVKGFYPSDIAVEWESNGQPENNYKTTPPVLDSDGSFFLYSKLTV
DKSRWQQGNVFSCSVMHEALHNHYTQKSLSLSPGK
SEQ ID NO: 741

14044_HC [hu anti-<huCDH19> 16C1.1 (1-469)(T92K) VH]::huIgG1z
QVQLQESGPGLVKPSETLSLTCTVSGGSISGYYWSWIRQPPGKGLEWIGYIYYIGSTNYNPSLKSRVTMS
IDTSKNQFSLKLSSLTAADTAVYFCARDGSSGWYRWFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 742

14045_HC [hu anti-<huCDH19> 17H8.2 VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARDSRYRSGWYDAFDIWGQGTMVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 743

14046_HC [hu anti-<huCDH19> 17H8.2 (1-471)(D109E) VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 744

14047_HC [hu anti-<huCDH19> 17H8.2 (1-471)(D109E,W132Y) VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGYYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 745

14048_HC [hu anti-<huCDH19> 17H8.2 (1-471)(D109E) VH]::huIgG1z
QVQLQESGPGLVKPSETLSLTCTVSGGSINSYYWSWIRQPPGKGLEWIGYIYYIGSTNYNPSLKSRVTISV
DTSKNQFSLKLSSVTAADTALYYCARESRYRSGWYDAFDIWGQGTMVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG TABLE IIIc-continued Heavy Chain Variable and Contant Region Polynucleotide
and Amino acid Sequences QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 746

14049_HC [hu anti-<huCDH19> 4F7 VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 747

14050_HC [hu anti-<huCDH19> 4F7 VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 748

14051_HC [hu anti-<huCDH19> 4F7 (1-468)(W113Y) VH]::huIgG1z
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNYAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 749

14052_HC [hu anti-<huCDH19> 4B10 (1-471)(R17G,D61E,D72E,W134Y) VH]::huIgG1z
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDYSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 750

14053_HC [hu anti-<huCDH19> 4B10 VH]::huIgG1z
QVQLVESGGGVVQPGRSLRLSCAASGFTFSSYDMHWVRQAPGKGLEWVAVISYDGTNEYYADSVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 751

14054_HC [hu anti-<huCDH19> 4B10 (1-471)(R17G) VH]::huIgG1z
QVQLVESGGGVVQPGGSLRLSCAASGFTFSSYDMHWVRQAPGKGLEWVAVISYDGTNEYYADSVKG
RFTISRDTSKNTLYLQMNSLRAEDTAVYYCARERYFDWSFDYWGQGTLVSVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 752

14055_HC [hu anti-<huCDH19> 4B10 (1-471)(R17G,D61E,D72E) VH]::huIgG1z
QVQLVESGGGVVQPGGSLRLSCAASGFTFSSYDMHWVRQAPGKGLEWVAVISYEGTNEYYAESVKGR
FTISRDTSKNTLYLQMNSLRAEDTAVYYCARERYFDWSFDYWGQGTLVSVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 753

14056_HC [hu anti-<huCDH19> 4A9 VH]::huIgG1z
QVQLQESGPGLVKPSETLSLTCTVSGGSISGYYWSWIRQPPGKGLEWFAYFSYSGSTNYNPSLKSRVTLS
VDTSKNQFSLKLSSVTAADTAVYYCARNWAFHFDFWGQGTLVTVSSASTKGPSVFPLAPSSKSTSGGT TABLE IIIc-continued Heavy Chain Variable and Contant Region Polynucleotide
and Amino acid Sequences AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 754

14057_HC [hu anti-<huCDH19> 4A9 (1-468)(F55I,A56G) VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 755

14058_HC [hu anti-<huCDH19> 4A9 (1-468)(F55I,A56G) VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNWAFHFDFWGQGTLVTVSSASTKGPSVFPLAPSSKSTSGGT
AALGCLVKDYFPEPVTVSWNSGALTSGVHTFPAVLQSSGLYSLSSVVTVPSSSLGTQTYICNVNHKPSN
TKVDKKVEPKSCDKTHTCPPCPAPELLGGPSVFLFPPKPKDTLMISRTPEVTCVVVDVSHEDPEVKFNW
YVDGVEVHNAKTKPREEQYNSTYRVVSVLTVLHQDWLNGKEYKCKVSNKALPAPIEKTISKAKGQPR
EPQVYTLPPSREEMTKNQVSLTCLVKGFYPSDIAVEWESNGQPENNYKTTPPVLDSDGSFFLYSKLTVD
KSRWQQGNVFSCSVMHEALHNHYTQKSLSLSPGK
SEQ ID NO: 756

14059_HC [hu anti-<huCDH19> 4A9 (1-468)(F55I,A56G,W113Y) VH]::huIgG1z
QVQLQESGPGLVKPSETLSLTCTVSGGSISGYYWSWIRQPPGKGLEWIGYFSYSGSTNYNPSLKSRVTLS
VDTSKNQFSLKLSSVTAADTAVYYCARNYAFHFDFWGQGTLVTVSSASTKGPSVFPLAPSSKSTSGGT
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 757

14060_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 758

14061_HC [hu anti-<huCDH19> 20D3.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 759

14062_HC [hu anti-<huCDH19> 20D3.1 (1-469)(W133Y) VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 760

14063_HC [hu anti-<huCDH19> 20D3.1 (1-469)(W133Y) VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 761

TABLE IIIc-continued

Heavy Chain Variable and Contant Region Polynucleotide
and Amino acid Sequences

14064_HC [hu anti-<huCDH19> 20D3.1 (1-469)(W133Y) VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHFDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 762

14065_HC [hu anti-<huCDH19> 22G10.1 (1-470)(S82R,A99E) VH]::huIgG1z
EVQLLESGGGLVQPGGSLRLSCAASGFTFSSYAMNWVRQAPGKGLEWVSTISGGGANTYYADSVKGR
FTISRDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 763

14066_HC [hu anti-<huCDH19> 22G10.1 (1-470)(A99E,H105Y) VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYYCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 764

14067_HC [hu anti-<huCDH19> 22G10.1 (1-470)(A99E) VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 765

14068_HC [hu anti-<huCDH19> 22G10.1 (1-470)(A99E) VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAEDTAVYHCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 766

14069_HC [hu anti-<huCDH19> 22G10.1 (1-470)(D72E,A99E) VH]::huIgG1z
EVQLLESGGGLVQPGGSLRLSCAASGFTFSSYAMNWVRQAPGKGLEWVSTISGGGANTYYAESVKGRF
TISSDNSKSTLYLQMNSLRAEDTAVYHCAKGGMGGYYYGMDVWGQGTTVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 767

14070_HC [hu anti-<huCDH19> 22G10.1 (1-470)(H105Y) VH]::huIgG1z
EVQLLESGGGLVQPGGSLRLSCAASGFTFSSYAMNWVRQAPGKGLEWVSTISGGGANTYYADSVKGR
FTISSDNSKSTLYLQMNSLRAADTAVYYCAKGGMGGYYYGMDVWGQGTTVTVSSASTKGPSVFPLAP
SSKSTSGGTAALGCLVKDYFPEPVTVSWNSGALTSGVHTFPAVLQSSGLYSLSSVVTVPSSSLGTQTYIC
NVNHKPSNTKVDKKVEPKSCDKTHTCPPCPAPELLGGPSVFLFPPKPKDTLMISRTPEVTCVVVDVSHE
DPEVKFNWYVDGVEVHNAKTKPREEQYNSTYRVVSVLTVLHQDWLNGKEYKCKVSNKALPAPIEKTI
SKAKGQPREPQVYTLPPSREEMTKNQVSLTCLVKGFYPSDIAVEWESNGQPENNYKTTPPVLDSDGSFF
LYSKLTVDKSRWQQGNVFSCSVMHEALHNHYTQKSLSLSPGK
SEQ ID NO: 768

14071_HC [hu anti-<huCDH19> 16A4.1 (1-474)(T144L) VH]::huIgG1z
QVQLQESGPGLAKPSETLSLTCTVSGDSITSYYWSWIRQPPGKGLEWIGYIIYYSGSTNYNPSLKSRVTISV
DTSKNQFSLKLSSVTAADTAVYYCARDQRRIAAAGTHFYGMDVWGQGTLVTVSSASTKGPSVFPLAPS
SKSTSGGTAALGCLVKDYFPEPVTVSWNSGALTSGVHTFPAVLQSSGLYSLSSVVTVPSSSLGTQTYICN
VNHKPSNTKVDKKVEPKSCDKTHTCPPCPAPELLGGPSVFLFPPKPKDTLMISRTPEVTCVVVDVSHEDP
EVKFNWYVDGVEVHNAKTKPREEQYNSTYRVVSVLTVLHQDWLNGKEYKCKVSNKALPAPIEKTISK

TABLE IIIc-continued

Heavy Chain Variable and Contant Region Polynucleotide and Amino acid Sequences

```
AKGQPREPQVYTLPPSREEMTKNQVSLTCLVKGFYPSDIAVEWESNGQPENNYKTTPPVLDSDGSFFLY
SKLTVDKSRWQQGNVFSCSVMHEALHNHYTQKSLSLSPGK
SEQ ID NO: 769

14072_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 770

14073_HC [hu anti-<huCDH19> 19B5.1 (1-469)(W133Y) VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 771

14074_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 772

14075_HC [hu anti-<huCDH19> 19B5.1 VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 773

14076_HC [hu anti-<huCDH19> 19B5.1 (1-469)(W133Y) VH]::huIgG1z
QVQLVQSGAEVKKPGASVKVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 774

14077_HC [hu anti-<huCDH19> 23A10.3 (1-474)(L92Q) VH]::huIgG1z
QVQLVESGGGVVQPGRSLRLSCAASGFTFSRYGIHWVRQAPGKGLEWVAVIWYDGSNKYYADSVKGR
FTISRDNSKNTLYLQMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 775

14078_HC [hu anti-<huCDH19> 23A10.3 (1-474)(R17G,L92Q) VH]::huIgG1z
QVQLVESGGGVVQPGGSLRLSCAASGFTFSRYGIHWVRQAPGKGLEWVAVIWYDGSNKYYADSVKG
RFTISRDNSKNTLYLQMNSLRAEDSAVYYCARRAGIPGTTGYYYGMDVWGQGTTVTVSSASTKGPSVF
PLAPSSKSTSGGTAALGCLVKDYFPEPVTVSWNSGALTSGVHTFPAVLQSSGLYSLSSVVTVPSSSLGTQ
TYICNVNHKPSNTKVDKKVEPKSCDKTHTCPPCPAPELLGGPSVFLFPPKPKDTLMISRTPEVTCVVVDV
SHEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 776

14079_HC [hu anti-<huCDH19> 23A10.3 (1-474)(R17G,D61E,D72E,L92Q) VH]::huIgG1z
QVQLVESGGGVVQPGGSLRLSCAASGFTFSRYGIHWVRQAPGKGLEWVAVIWYEGSNKYYAESVKGR
FTISRDNSKNTLYLQMNSLRAEDSAVYYCARRAGIPGTTGYYYGMDVWGQGTTVTVSSASTKGPSVFP
```

TABLE IIIc-continued

Heavy Chain Variable and Contant Region Polynucleotide
and Amino acid Sequences

LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 777

14080_HC [hu anti-<huCDH19> 23A10.3 VH]::huIgG1z
QVQLVESGGGVVQPGRSLRLSCAASGFTFSRYGIHWVRQAPGKGLEWVAVIWYDGSNKYYADSVKGR
FTISRDNSKNTLYLLMNSLRAEDSAVYYCARRAGIPGTTGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 778

14081_HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCARDGSSGWYRWFDPWGQGTLVTVSSASTKGPSVFPLAPSSKST
SGGTAALGCLVKDYFPEPVTVSWNSGALTSGVHTFPAVLQSSGLYSLSSVVTVPSSSLGTQTYICNVNH
KPSNTKVDKKVEPKSCDKTHTCPPCPAPELLGGPSVFLFPPKPKDTLMISRTPEVTCVVVDVSHEDPEVK
FNWYVDGVEVHNAKTKPREEQYNSTYRVVSVLTVLHQDWLNGKEYKCKVSNKALPAPIEKTISKAKG
QPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK
SEQ ID NO: 779

14082_HC [hu anti-<huCDH19> 25G10.1 (1-469)(D109E,W132Y,W135Y) VH]::huIgG1z
QVQLQESGPGLVKPSETLSLTCTVSGGSISGYYWSWIRQPPGKGLEWIGYIYYIGSTNYNPSLKSRVTMS
VDTSKNQFSLKLSSVTAADTAVYYCAREGSSGYYRYFDPWGQGTLVTVSSASTKGPSVFPLAPSSKSTS
GGTAALGCLVKDYFPEPVTVSWNSGALTSGVHTFPAVLQSSGLYSLSSVVTVPSSSLGTQTYICNVNHK
PSNTKVDKKVEPKSCDKTHTCPPCPAPELLGGPSVFLFPPKPKDTLMISRTPEVTCVVVDVSHEDPEVKF
NWYVDGVEVHNAKTKPREEQYNSTYRVVSVLTVLHQDWLNGKEYKCKVSNKALPAPIEKTISKAKGQ
PREPQVYTLPPSREEMTKNQVSLTCLVKGFYPSDIAVEWESNGQPENNYKTTPPVLDSDGSFFLYSKLT
VDKSRWQQGNVFSCSVMHEALHNHYTQKSLSLSPGK
SEQ ID NO: 780

14083_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 781

14084_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 782

14085_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 783

14086_HC [hu anti-<huCDH19> 26D1.1 VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 784

TABLE IIIc-continued

Heavy Chain Variable and Contant Region Polynucleotide
and Amino acid Sequences

14087_HC [hu anti-<huCDH19> 26D1.1 (1-469)(W133Y) VH]::huIgG1z
QVQLVQSGAEVKKPGASVKVSCKASRYTFTSYYMSWVRQAPGQGLEWMGIIHPSGGDTTYAQKFQGR
VTMTGDTSTSTVYMELSSLRSEDTAVYYCARGGIKLYLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 785

14088_HC [hu anti-<huCDH19> 26D1.1 (1-469)(R27G,G82R) VH]::huIgG1z
QVQLVQSGAEVKKPGASVKVSCKASGYTFTSYYMSWVRQAPGQGLEWMGIIHPSGGDTTYAQKFQGR
VTMTRDTSTSTVYMELSSLRSEDTAVYYCARGGIKLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 786

14089_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 787

14090_HC [hu anti-<huCDH19> 26F12.1 VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 788

14091_HC [hu anti-<huCDH19> 26F12.1 (1-469)(W133Y) VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 789

14092_HC [hu anti-<huCDH19> 26F12.1 (1-469)(W133Y) VH]::huIgG1z
QVQLVQSGAEVKKPGASVKVSCKASRYTFTNYYMSWVRQAPGQGLEWMGIINPSGGDSTYAQKFQG
RLTMTGDTSTSTVYMELSSLRSEDTAVYYCARGGIQLYLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 790

14093_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 791

14094_HC [hu anti-<huCDH19> 25F8.1 VH]::huIgG1z
QVQLVQSGAEVKKPGASVKVSCKASGYTFTSYYIHWVRQAPGQGLEWMGIINPSGGSTRYAQKFQGR
VTMTRDTSTSTVFMELSSLRSEDTAVYYCARGGIQLWLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK TABLE IIIc-continued Heavy Chain Variable and Contant Region Polynucleotide and Amino acid Sequences GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 792

14095_HC [hu anti-<huCDH19> 25F8.1 (1-469)(F90Y) VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 793

14096_HC [hu anti-<huCDH19> 25F8.1 (1-469)(F90Y) VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLWLHFDYWGQGTLVTVSSASTKGPSVFPLAPSS
KSTSGGTAALGCLVKDYFPEPVTVSWNSGALTSGVHTFPAVLQSSGLYSLSSVVTVPSSSLGTQTYICNV
NHKPSNTKVDKKVEPKSCDKTHTCPPCPAPELLGGPSVFLFPPKPKDTLMISRTPEVTCVVVDVSHEDPE
VKFNWYVDGVEVHNAKTKPREEQYNSTYRVVSVLTVLHQDWLNGKEYKCKVSNKALPAPIEKTISKA
KGQPREPQVYTLPPSREEMTKNQVSLTCLVKGFYPSDIAVEWESNGQPENNYKTTPPVLDSDGSFFLYS
KLTVDKSRWQQGNVFSCSVMHEALHNHYTQKSLSLSPGK
SEQ ID NO: 794

14097_HC [hu anti-<huCDH19> 25F8.1 (1-469)(F90Y,W133Y) VH]::huIgG1z
QVQLVQSGAEVKKPGASVKVSCKASGYTFTSYYIHWVRQAPGQGLEWMGIINPSGGSTRYAQKFQGR
VTMTRDTSTSTVYMELSSLRSEDTAVYYCARGGIQLYLHFDYWGQGTLVTVSSASTKGPSVFPLAPSSK
STSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 795

14098_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 796

14099_HC [hu anti-<huCDH19> 22D1.1 VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLWLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 797

14100_HC [hu anti-<huCDH19> 22D1.1 (1-469)(W133Y) VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 798

14101_HC [hu anti-<huCDH19> 22D1.1 (1-469)(W133Y) VH]::huIgG1z
QVQLVQSGAEVKKPGASVRVSCKVSGYTFTSYFIHWVRQAPGQGLEWMGIINPISVSTSYAQKFQGRV
TMTRDTSTSTVFMELSSLRSEDTAVYYCARGGIQLYLHLDYWGQGTLVTVSSASTKGPSVFPLAPSSKS
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 799

14102_HC [hu anti-<huCDH19> 22D1.1 (1-469)(F90Y) VH]::huIgG1z
QVQLVQSGAEVKKPGASVRVSCKVSGYTFTSYFIHWVRQAPGQGLEWMGIINPISVSTSYAQKFQGRV
TMTRDTSTSTVYMELSSLRSEDTAVYYCARGGIQLWLHLDYWGQGTLVTVSSASTKGPSVFPLAPSSKS

TABLE IIIc-continued

Heavy Chain Variable and Contant Region Polynucleotide and Amino acid Sequences

```
TSGGTAALGCLVKDYFPEPVTVSWNSGALTSGVHTFPAVLQSSGLYSLSSVVTVPSSSLGTQTYICNVN
HKPSNTKVDKKVEPKSCDKTHTCPPCPAPELLGGPSVFLFPPKPKDTLMISRTPEVTCVVVDVSHEDPEV
KFNWYVDGVEVHNAKTKPREEQYNSTYRVVSVLTVLHQDWLNGKEYKCKVSNKALPAPIEKTISKAK
GQPREPQVYTLPPSREEMTKNQVSLTCLVKGFYPSDIAVEWESNGQPENNYKTTPPVLDSDGSFFLYSK
LTVDKSRWQQGNVFSCSVMHEALHNHYTQKSLSLSPGK
SEQ ID NO: 800
```

13591_HC [hu anti-<huCDH19> 4F7 VH]::huIgG1z

```
QVQLQESGPGLVKPSETLSLTCTVSGGSISSYSWSWIRQPPGKGLEWIGYIYYSGSTNYNPSLKSRVTISL
DTSKNQFSLKLSSVTAADTAVYYCARNWAFHFDYWGQGTLVTVSSASTKGPSVFPLAPSSKSTSGGTA
ALGCLVKDYFPEPVTVSWNSGALTSGVHTFPAVLQSSGLYSLSSVVTVPSSSLGTQTYICNVNHKPSNT
KVDKKVEPKSCDKTHTCPPCPAPELLGGPSVFLFPPKPKDTLMISRTPEVTCVVVDVSHEDPEVKFNWY
VDGVEVHNAKTKPREEQYNSTYRVVSVLTVLHQDWLNGKEYKCKVSNKALPAPIEKTISKAKGQPREP
QVYTLPPSREEMTKNQVSLTCLVKGFYPSDIAVEWESNGQPENNYKTTPPVLDSDGSFFLYSKLTVDKS
RWQQGNVFSCSVMHEALHNHYTQKSLSLSPGK
SEQ ID NO: 801
```

14301_HC [hu anti-<huCDH19> 2G6 VH]::huIgG1z

```
QVQLVESGGGVVQPGRSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 802
```

14302_HC [hu anti-<huCDH19> 2G6 (1-477)(R17G,K94N) VH]::huIgG1z

```
QVQLVESGGGVVQPGGSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 803
```

14303_HC [hu anti-<huCDH19> 2G6 (1-477)(D61E,D72E) VH]::huIgG1z

```
QVQLVESGGGVVQPGRSLRLSCAASGFTFSSYGMHWVRQAPGKGLEWVAFIWYEGSNKYYAESVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 804
```

14304_HC [hu anti-<huCDH19> 2G6 (1-477)(R17G) VH]::huIgG1z

```
QVQLVESGGGVVQPGGSLRLSCAASGFTFSSYGMHWVRQAPGKGLEWVAFIWYDGSNKYYADSVKD
RFTISRDNSKNTLYLQMKSLRAEDTAVYYCARRAGIIGTIGYYYGMDVWGQGTTVTVSSASTKGPSVFP
LAPSSKSTSGGTAALGCLVKDYFPEPVTVSWNSGALTSGVHTFPAVLQSSGLYSLSSVVTVPSSSLGTQT
YICNVNHKPSNTKVDKKVEPKSCDKTHTCPPCPAPELLGGPSVFLFPPKPKDTLMISRTPEVTCVVVDVS
HEDPEVKFNWYVDGVEVHNAKTKPREEQYNSTYRVVSVLTVLHQDWLNGKEYKCKVSNKALPAPIE
KTISKAKGQPREPQVYTLPPSREEMTKNQVSLTCLVKGFYPSDIAVEWESNGQPENNYKTTPPVLDSDG
SFFLYSKLTVDKSRWQQGNVFSCSVMHEALHNHYTQKSLSLSPGK
SEQ ID NO: 805
```

TABLE IIId

Light Chain Variable and Contant Region Polynucleotide and Amino acid Sequences

13586_LC [hu anti-<huCDH19> 4F3 VL]::huKLC

```
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 806
```

13589_LC [hu anti-<huCDH19> 4A9 VL]::huLLC-C1

```
QSVLTQPPSVSGAPGQRVTISCTGSSSNIGTGYAVHWYQQFPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
```

TABLE IIId-continued

Light Chain Variable and Constant Region Polynucleotide and Amino acid Sequences LISDFYPGAVTVAWKADGSPVKAGVETTKPSKQSNNKYAASSYLSLTPEQWKSHRSYSCQVTHEGSTV
EKTVAPTECS
SEQ ID NO: 807

13590_LC [hu anti-<huCDH19> 4B10 VL]::huKLC
EIVLTQSPGTLSLSPGERATLSCRASQSVSNTYLAWYHQRPGQAPRLLIYGASSRATGIPDRFSGSGSTD
FALTISSLEPEDFAVYYCQQYSNSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 808

13874_LC [hu anti-<huCDH19> 17H8.2 VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKGTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 809

13875_LC [hu anti-<huCDH19> 16C1.1 VL]::huKLC
EIVLTQSPGTLSLSPGERATLSCRASQSVSSSYLAWYQQKPGQAPRLLIFGASSRATGIPDRFSGSGSTD
FTLTISGLEPEDFAVYHCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 810

13876_LC [hu anti-<huCDH19> 16A4.1 VL]::huKLC
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 811

13877_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 812

13878_LC [hu anti-<huCDH19> 20D3.1 VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 813

13879_LC [hu anti-<huCDH19> 22D1.1 VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 814

13880_LC [hu anti-<huCDH19> 25F8.1 VL]::huLLC-C2
QSALTQPPSATGTPGQRVTISCSGSSSNIGRNFVNWYKQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 815

13881_LC [hu anti-<huCDH19> 26F12.1 VL]::huLLC-C2
QSVLTQSPSASGTPGQRVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 816

13882_LC [hu anti-<huCDH19> 26D1.1 VL]::huLLC-C2
HSVLTQSPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 817

13883_LC [hu anti-<huCDH19> 25G10.1 VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYHCQQYGNSPLTFGGGTKVEIKRTVAAPSVFIFPPSDEQLKSGTASVVCLLNNFYP TABLE IIId-continued Light Chain Variable and Contant Region Polynucleotide
and Amino acid Sequences REAKVQWKVDNALQSGNSQESVTEQDSKDSTYSLSSTLTLSKADYEKHKVYACEVTHQGLSSPVTKSF
NRGEC
SEQ ID NO: 818

13885_LC [hu anti-<huCDH19> 19B5.1 VL]::huLLC-C2
QSALTQPPSTTGTPGQRVTISCSGSRSNIGSNFVNWYKQLPGTAPKVLIYTNNQRPSGVPDRFSGSKSGTS
ASLAISGLQSEDESDYYCATWDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 819

14022_LC [hu anti-<huCDH19> 4A2 (1-236)(N30Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFTVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 820

14024_LC [hu anti-<huCDH19> 4A2 (1-236)(N30Q,T102A,P141Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGQGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 821

14025_LC [hu anti-<huCDH19> 4A2 (1-236)(N30Q,T102A) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 822

14026_LC [hu anti-<huCDH19> 4A2 (1-236)(N30Q,T102A) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 823

14027_LC [hu anti-<huCDH19> 4A2 (1-236)(N30Q,T102A,P141Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 824

14028_LC [hu anti-<huCDH19> 4A2 (1-236)(N30Q,T102A,P141Q) VL]::huKLC
EIVLTQSPGTLSLSPGERATLSCRASRQISSSYLAWYQQKPGQAPRLLIYGPSSRATGIPDRFSGSGSGTDF
TLTISRLEPEDFAVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 825

14029_LC [hu anti-<huCDH19> 4A2 (1-236)(R29Q,N30S) VL]::huKLC
EIVLTQSPGTLSLSPGERATLSCRASQSISSSYLAWYQQKPGQAPRLLIYGPSSRATGIPDRFSGSGSGTDF
TLTISRLEPEDFTVYYCQQYGSSFTFGPGTKVDIKRTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNR
GEC
SEQ ID NO: 826

14030_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 827

14031_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 828

14032_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP

TABLE IIId-continued

Light Chain Variable and Contant Region Polynucleotide
and Amino acid Sequences

REAKVQWKVDNALQSGNSQESVTEQDSKDSTYSLSSTLTLSKADYEKHKVYACEVTHQGLSSPVTKSF
NRGEC
SEQ ID NO: 829

14033_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 830

14034_LC [hu anti-<huCDH19> 4F3 VL]::huKLC
EIVLTQSPGTLSLSPGERATLSCRASQSVSSSYLAWYQQKPGQAPRLLIYGASSRATGIPDRFSGSGSGTD
FTLTISRLEPEDFAVYYCQQYGSSWTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 831

14039_LC [hu anti-<huCDH19> 2G6 (1-234)(C42S,D110E) VL]::huLLC-C1
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 832

14040_LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 833

14041_LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 834

14042_LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 835

14043_LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISGLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 836

14044_LC [hu anti-<huCDH19> 16C1.1 (1-235)(G95R,H105Y,G141Q) VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 837

14045_LC [hu anti-<huCDH19> 17H8.2 (1-235)(G149R) VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 838

14046_LC [hu anti-<huCDH19> 17H8.2 (1-235)(G149R) VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 839

14047_LC [hu anti-<huCDH19> 17H8.2 (1-235)(G149R) VL]::huKLC
DIVLTQSPGTLSLSPGERATLSCRASQSVAGSYLAWYQQKPGQAPRLLISGASSRATGIPDRFSGSGSGT
DFTLTISRLEPEDFAVYYCQQYGKSPITFGQGTRLEMKRTVAAPSVFIFPPSDEQLKSGTASVVCLLNNF TABLE IIId-continued Light Chain Variable and Contant Region Polynucleotide
and Amino acid Sequences YPREAKVQWKVDNALQSGNSQESVTEQDSKDSTYSLSSTLTLSKADYEKHKVYACEVTHQGLSSPVTK
SFNRGEC
SEQ ID NO: 840

14048_LC [hu anti-<huCDH19> 17H8.2 (1-235)(S57Y,G149R) VL]::huKLC
DIVLTQSPGTLSLSPGERATLSCRASQSVAGSYLAWYQQKPGQAPRLLIYGASSRATGIPDRFSGSGSGT
DFTLTISRLEPEDFAVYYCQQYGKSPITFGQGTRLEMKRTVAAPSVFIFPPSDEQLKSGTASVVCLLNNF
YPREAKVQWKVDNALQSGNSQESVTEQDSKDSTYSLSSTLTLSKADYEKHKVYACEVTHQGLSSPVTK
SFNRGEC
SEQ ID NO: 841

14049_LC [hu anti-<huCDH19> 4F7 (1-239)(H57Y) VL]::huLLC-C2
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 842

14050_LC [hu anti-<huCDH19> 4F7 (1-239)(H57Y,D110E) VL]::huLLC-C2
QSVLTQPPSVSGAPGQRVTISCTGSSSNIGTGYDVHWYQQLPGTAPKLLIYGNSNRPSGVPDRFSGSKSG
TSASLAITGLQAEDEADYYCQSYESSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 843

14051_LC [hu anti-<huCDH19> 4F7 (1-239)(D110E) VL]::huLLC-C2
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYESSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 844

14052_LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 845

14053_LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 846

14054_LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 847

14055_LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTD
FTLTISSLEPEDFAVYYCQQYSNSWTFGQGTKVEIKRTVAAPSVFIFPPSDEQLKSGTASVVCLLNNFYPR
EAKVQWKVDNALQSGNSQESVTEQDSKDSTYSLSSTLTLSKADYEKHKVYACEVTHQGLSSPVTKSFN
RGEC
SEQ ID NO: 848

14056_LC [hu anti-<huCDH19> 4A9 (1-239)(F47L) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 849

14057_LC [hu anti-<huCDH19> 4A9 (1-239)(F47L) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYDSRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 850

14058_LC [hu anti-<huCDH19> 4A9 (1-239)(F47L,D110E) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLGQPKANPTVTLFPPSSEELQANKATLVC TABLE IIId-continued Light Chain Variable and Contant Region Polynucleotide
and Amino acid Sequences LISDFYPGAVTVAWKADGSPVKAGVETTKPSKQSNNKYAASSYLSLTPEQWKSHRSYSCQVTHEGSTV
EKTVAPTECS
SEQ ID NO: 851

14059_LC [hu anti-<huCDH19> 4A9 (1-239)(F47L,D110E) VL]::huLLC-C1
QSVLTQPPSVSGAPGQRVTISCTGSSSNIGTGYAVHWYQQLPGTAPKLLIYGNNNRPSGVPDRFSGSKSG
TSASLAITGLQAEDEADYYCQSYESRLSGWVFGGGTKLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 852

14060_LC [hu anti-<huCDH19> 20D3.1 (1-235)(S102A) VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 853

14061_LC [hu anti-<huCDH19> 20D3.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 854

14062_LC [hu anti-<huCDH19> 20D3.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 855

14063_LC [hu anti-<huCDH19> 20D3.1 (1-235)
(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 856

14064_LC [hu anti-<huCDH19> 20D3.1 (1-235)(W109Y) VL]::huLLC-C2
QSALTQPPSATGTPGQRVTISCSGSSSNIGSNFVNWYKQLPGTAPKVLIYTNNQRPSGVPDRFSGSKSGTS
ASLAISGLQSEDESDYYCATYDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 857

14065_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 858

14066_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 859

14067_LC [hu anti-<huCDH19> 22G10.1 (1-234)(Q97E,S98P) VL]::huKLC
EIVMTQSPVTLSLSLGERATLSCRASQSISSNLAWFQQKPGQAPRLLIYGAFTRATGIPARVSGSGSGTEF
TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 860

14068_LC [hu anti-<huCDH19> 22G10.1 (1-234)(V78F,Q97E,S98P) VL]::huKLC
EIVMTQSPVTLSLSLGERATLSCRASQSISSNLAWFQQKPGQAPRLLIYGAFTRATGIPARFSGSGSGTEF
TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 861

14069_LC [hu anti-<huCDH19> 22G10.1 (1-234)(V78F,Q97E,S98P) VL]::huKLC
EIVMTQSPVTLSLSLGERATLSCRASQSISSNLAWFQQKPGQAPRLLIYGAFTRATGIPARFSGSGSGTEF

TABLE IIId-continued

Light Chain Variable and Contant Region Polynucleotide
and Amino acid Sequences

TLTISSLEPEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 862

14070_LC [hu anti-<huCDH19> 22G10.1 VL]::huKLC
EIVMTQSPVTLSLSLGERATLSCRASQSISSNLAWFQQKPGQAPRLLIYGAFTRATGIPARVSGSGSGTEF
TLTISSLQSEDFAVYYCQQYNYWPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 863

14071_LC [hu anti-<huCDH19> 16A4.1 (1-235)(G141Q) VL]::huKLC
EIVLTQSPGTLSLSPGERATLSCRASQSVSSSYLAWYQQKPGQAPRLLIYGTSSRATGIPDRFSGSGSGTD
FTLTISRLEPEDFAVYYCQQYGSSPFTFGQGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 864

14072_LC [hu anti-<huCDH19> 19B5.1 (1-235)(K45Q,S102A) VL]::huLLC-C2
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 865

14073_LC [hu anti-<huCDH19> 19B5.1 (1-235)(K45Q,S102A) VL]::huLLC-C2
QSALTQPPSTTGTPGQRVTISCSGSRSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 866

14074_LC [hu anti-<huCDH19> 19B5.1 (1-235)(T11V,K45Q,S102A) VL]::huLLC-C2
QSALTQPPSVTGTPGQRVTISCSGSRSNIGSNFVNWYQQLPGTAPKVLIYTNNQRPSGVPDRFSGSKSGT
SASLAISGLQSEDEADYYCATWDDSMNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 867

14075_LC [hu anti-<huCDH19> 19B5.1 (1-235)
(T11V,K45Q,S102A,D111E,N135Q) VL]::huLLC-C2
QSALTQPPSVTGTPGQRVTISCSGSRSNIGSNFVNWYQQLPGTAPKVLIYTNNQRPSGVPDRFSGSKSGT
SASLAISGLQSEDEADYYCATWDESMQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 868

14076_LC [hu anti-<huCDH19> 19B5.1 (1-235)
(T11V,K45Q,S102A,W109Y,D111E,N135Q) VL]::huLLC-C2
QSALTQPPSVTGTPGQRVTISCSGSRSNIGSNFVNWYQQLPGTAPKVLIYTNNQRPSGVPDRFSGSKSGT
SASLAISGLQSEDEADYYCATYDESMQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 869

14077_LC [hu anti-<huCDH19> 23A10.3 (1-231)(C42S) VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 870

14078_LC [hu anti-<huCDH19> 23A10.3 (1-231)(C42S) VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 871

14079_LC [hu anti-<huCDH19> 23A10.3 (1-231)(C42S,D110E) VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWESSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 872

TABLE IIId-continued

Light Chain Variable and Contant Region Polynucleotide
and Amino acid Sequences

14080_LC [hu anti-<huCDH19> 23A10.3 (1-231)(C42Y) VL]::huLLC-C2
SYELTQPPSVSVSPGQTASITCSGDRLGEKYVYWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 873

14081_LC [hu anti-<huCDH19> 25G10.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 874

14082_LC [hu anti-<huCDH19> 25G10.1 (1-235)(H105Y) VL]::huKLC
EIVLTQSPGTLSLSPGERATLSCRASQSVSSSYLAWYQQKPGQAPRLLIFGASSRATGIPDRFSGSGSGTD
FTLTISRLEPEDFAVYYCQQYGNSPLTFGGGTKVEIKRTVAAPSVFIFPPSDEQLKSGTASVVCLLNNFYP
REAKVQWKVDNALQSGNSQESVTEQDSKDSTYSLSSTLTLSKADYEKHKVYACEVTHQGLSSPVTKSF
NRGEC
SEQ ID NO: 875

14083_LC [hu anti-<huCDH19> 26D1.1 (1-235)(S7P) VL]::huLLC-C2
HSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 876

14084_LC [hu anti-<huCDH19> 26D1.1 (1-235)(H1Q,S7P) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 877

14085_LC [hu anti-<huCDH19> 26D1.1 (1-235)(H1Q,S7P,W109Y) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 878

14086_LC [hu anti-<huCDH19> 26D1.1 (1-235)
(H1Q,S7P,W109Y,D111E,N135Q) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 879

14087_LC [hu anti-<huCDH19> 26D1.1 (1-235)
(H1Q,S7P,W109Y,D111E,N135Q) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 880

14088_LC [hu anti-<huCDH19> 26D1.1 (1-235)(H1Q,S7P) VL]::huLLC-C2
QSVLTQPPSASGTPGQRVTISCSGSRSNIGSNFVNWYQQLPGTAPKLLIYTNNQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 881

14089_LC [hu anti-<huCDH19> 26F12.1 (1-235)(S7P) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDDSLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 882

14090_LC [hu anti-<huCDH19> 26F12.1 (1-235)(S7P,D111E) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLGQPKAAPSVTLFPPSSEELQANKATLVCLI TABLE IIId-continued Light Chain Variable and Contant Region Polynucleotide
and Amino acid Sequences SDFYPGAVTVAWKADSSPVKAGVETTTPSKQSNNKYAASSYLSLTPEQWKSHRSYSCQVTHEGSTVEK
TVAPTECS
SEQ ID NO: 883

14091_LC [hu anti-<huCDH19> 26F12.1 (1-235)(S7P,D111E) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVWDESLNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 884

14092_LC [hu anti-<huCDH19> 26F12.1 (1-235)
(S7P,W109Y,D111E,N135Q) VL]::huLLC-C2
QSVLTQPPSASGTPGQKVTISCSGSRSNIGSNFVNWYQQLPGTAPKLLIYTNYQRPSGVPDRFSGSKSGTS
ASLAISGLQSEDEADYYCAVYDESLQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 885

14093_LC [hu anti-<huCDH19> 25F8.1 (1-235)(K45Q) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDESDYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 886

14094_LC [hu anti-<huCDH19> 25F8.1 (1-235)(K45Q,S102A) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 887

14095_LC [hu anti-<huCDH19> 25F8.1 (1-235)(K45Q,S102A) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDDSLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 888

14096_LC [hu anti-<huCDH19> 25F8.1 (1-235)(K45Q,S102A,D111E) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLNGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 889

14097_LC [hu anti-<huCDH19> 25F8.1 (1-235)
(K45Q,S102A,D111E,N135Q) VL]::huLLC-C2
QSALTQPPSATGTPGQRVTISCSGSSSNIGRNFVNWYQQLPGTAPKVLIYTNNQRPSGVPDRFSGSKSGT
SASLAISGLQSEDEADYYCAAWDESLQGWVFGGGTKLTVLGQPKAAPSVTLFPPSSEELQANKATLVC
LISDFYPGAVTVAWKADSSPVKAGVETTTPSKQSNNKYAASSYLSLTPEQWKSHRSYSCQVTHEGSTV
EKTVAPTECS
SEQ ID NO: 890

14098_LC [hu anti-<huCDH19> 22D1.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 891

14099_LC [hu anti-<huCDH19> 22D1.1 (1-235)
(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDESMQGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 892

14100_LC [hu anti-<huCDH19> 22D1.1 (1-235)
(K45Q,S102A,W109Y,D111E,N135Q) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATYDESMQGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 893

TABLE IIId-continued

Light Chain Variable and Contant Region Polynucleotide
and Amino acid Sequences

14101_LC [hu anti-<huCDH19> 22D1.1 (1-235)(K45Q,S102A,W109Y) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATYDDSMNGWVFGGGTKLTVLGQPKAAPSVTLFPPSSEELQANKATLVCLI
SDFYPGAVTVAWKADSSPVKAGVETTTPSKQSNNKYAASSYLSLTPEQWKSHRSYSCQVTHEGSTVEK
TVAPTECS
SEQ ID NO: 894

14102_LC [hu anti-<huCDH19> 22D1.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTS
ASLAISGLQSEDEADYYCATWDDSMNGWVFGGGTKLTVLGQPKAAPSVTLFPPSSEELQANKATLVCL
ISDFYPGAVTVAWKADSSPVKAGVETTTPSKQSNNKYAASSYLSLTPEQWKSHRSYSCQVTHEGSTVE
KTVAPTECS
SEQ ID NO: 895

13591_LC [hu anti-<huCDH19> 4F7 VL]::huLLC-C1
QSVLTQPPSVSGAPGQRVTISCTGSSSNIGTGYDVHWYQQLPGTAPKLLIHGNSNRPSGVPDRFSGSKSG
TSASLAITGLQAEDEADYYCQSYDSSLSGWVFGGGTRLTVLGQPKANPTVTLFPPSSEELQANKATLVC
LISDFYPGAVTVAWKADGSPVKAGVETTKPSKQSNNKYAASSYLSLTPEQWKSHRSYSCQVTHEGSTV
EKTVAPTECS
SEQ ID NO: 896

14301_LC [hu anti-<huCDH19> 2G6 (1-234)(D110E) VL]::huLLC-C1
SYELTQPPSVSVSPGQTASITCSGDRLGEKYTCWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 897

14302_LC [hu anti-<huCDH19> 2G6 (1-234)(C42S,D110E) VL]::huLLC-C1
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 898

14303_LC [hu anti-<huCDH19> 2G6 (1-234)(C42S,D110E) VL]::huLLC-C1
SYELTQPPSVSVSPGQTASITCSGDRLGEKYTSWYQQRPGQSPLLVIYQDTKRPSGIPERFSGSNSGNTAT
LTISGTQAMDEADYYCQAWESSTVVFGGGTKLTVLGQPKANPTVTLFPPSSEELQANKATLVCLISDFY
PGAVTVAWKADGSPVKAGVETTKPSKQSNNKYAASSYLSLTPEQWKSHRSYSCQVTHEGSTVEKTVA
PTECS
SEQ ID NO: 899

14304_LC [hu anti-<huCDH19> 23A10.3 (1-231)(C42S) VL]::huLLC-C2
SYELTQPPSVSVSPGQTASITCSGDRLGEKYVSWYQQKPGQSPILVIYQDNKWPSGIPERFSGSNSGNTA
TLTISGTQAMDEADYYCQAWDSSTVVFGGGTKLTVLGQPKAAPSVTLFPPSSEELQANKATLVCLISDF
YPGAVTVAWKADSSPVKAGVETTTPSKQSNNKYAASSYLSLTPEQWKSHRSYSCQVTHEGSTVEKTV
APTECS
SEQ ID NO: 900

TABLE IVa

HEAVY CHAIN CDRs

| Ab | Type | CDR 1 | CDR 2 | CDR 3 |
|---|---|---|---|---|
| 14039 14303 | AA | SYGMH SEQ ID NO: 28 | FIWYEGSNKYYAESVKD SEQ ID NO: 901 | RAGIIGTIGYYYGMDV SEQ ID NO: 30 |
| 14027 | AA | SSGYYWS SEQ ID NO: 46 | YIYYTGSAYYNPSLKS SEQ ID NO: 47 | EGSSGWYFQY SEQ ID NO: 902 |
| 14028 | AA | SSGYYWS SEQ ID NO: 46 | YIYYTGSAYYNPSLKS SEQ ID NO: 47 | EGSSGYYFQY SEQ ID NO: 903 |
| 14059 | AA | GYYWS SEQ ID NO: 52 | YFSYSGSTNYNPSLKS SEQ ID NO: 53 | NYAFHFDF SEQ ID NO: 904 |
| 14052 | AA | SYDMH SEQ ID NO: 58 | VISYEGTNEYYAESVKG SEQ ID NO: 905 | ERYFDYSFDY SEQ ID NO: 906 |
| 14055 | AA | SYDMH SEQ ID NO: 58 | VISYEGTNEYYAESVKG SEQ ID NO: 905 | ERYFDWSFDY SEQ ID NO: 60 |

TABLE IVa-continued

HEAVY CHAIN CDRs

| Ab | Type | CDR 1 | CDR 2 | CDR 3 |
|---|---|---|---|---|
| 14033 | AA | SYDMD<br>SEQ ID NO: 70 | VIWYEGSNKYYAESVRG<br>SEQ ID NO: 907 | ETGEGWYFDL<br>SEQ ID NO: 72 |
| 14034 | AA | SYDMD<br>SEQ ID NO: 70 | VIWYEGSNKYYAESVRG<br>SEQ ID NO: 907 | ETGEGYYFDL<br>SEQ ID NO: 908 |
| 14051 | AA | SYSWS<br>SEQ ID NO: 82 | YIYYSGSTNYNPSLKS<br>SEQ ID NO: 83 | NYAFHFDY<br>SEQ ID NO: 909 |
| 14046<br>14048 | AA | SYYWS<br>SEQ ID NO: 94 | YIYYIGSTNYNPSLKS<br>SEQ ID NO: 95 | ESRYRSGWYDAFDI<br>SEQ ID NO: 910 |
| 14047 | AA | SYYWS<br>SEQ ID NO: 94 | YIYYIGSTNYNPSLKS<br>SEQ ID NO: 95 | ESRYRSGYYDAFDI<br>SEQ ID NO: 911 |
| 14042 | AA | GYYWS<br>SEQ ID NO: 100 | YIYYIGSTNYNPSLKS<br>SEQ ID NO: 101 | EGSSGWYRWFDP<br>SEQ ID NO: 912 |
| 14043 | AA | GYYWS<br>SEQ ID NO: 100 | YIYYIGSTNYNPSLKS<br>SEQ ID NO: 101 | DGSSGYYRYFDP<br>SEQ ID NO: 913 |
| 14069 | AA | SYAMN<br>SEQ ID NO: 118 | TISGGGANTYYAESVKG<br>SEQ ID NO: 914 | GGMGGYYYGMDV<br>SEQ ID NO: 120 |
| 14062<br>14063<br>14064 | AA | SYFIH<br>SEQ ID NO: 124 | IINPISVSTSYAQKFQG<br>SEQ ID NO: 125 | GGIQLYLHFDY<br>SEQ ID NO: 915 |
| 14100<br>14101 | AA | SYFIH<br>SEQ ID NO: 130 | IINPISVSTSYAQKFQG<br>SEQ ID NO: 131 | GGIQLYLHLDY<br>SEQ ID NO: 916 |
| 14097 | AA | SYYIH<br>SEQ ID NO: 136 | IINPSGGSTRYAQKFQG<br>SEQ ID NO: 137 | GGIQLYLHFDY<br>SEQ ID NO: 917 |
| 14091<br>14092 | AA | NYYMS<br>SEQ ID NO: 142 | IINPSGGDSTYAQKFQG<br>SEQ ID NO: 143 | GGIQLYLHFDY<br>SEQ ID NO: 918 |
| 14087 | AA | SYYMS<br>SEQ ID NO: 148 | IIHPSGGDTTYAQKFQG<br>SEQ ID NO: 149 | GGIKLYLHFDY<br>SEQ ID NO: 919 |
| 14082 | AA | GYYWS<br>SEQ ID NO: 154 | YIYYIGSTNYNPSLKS<br>SEQ ID NO: 155 | EGSSGYYRYFDP<br>SEQ ID NO: 920 |
| 14079 | AA | RYGIH<br>SEQ ID NO: 160 | VIWYEGSNKYYAESVKG<br>SEQ ID NO: 921 | RAGIPGTTGYYYGMDV<br>SEQ ID NO: 162 |
| 14073<br>14076 | AA | SYFIH<br>SEQ ID NO: 1 | IINPISVSTSYAQKFQG<br>SEQ ID NO: 2 | GGIQLYLHLDY<br>SEQ ID NO: 3 |
|  | AA | SYGMH<br>SEQ ID NO: 4 | VIWYDGSNKYYADSVKG<br>SEQ ID NO: 5 | RAGIIGTTGYYYGMDV<br>SEQ ID NO: 6 |

TABLE IVb

LIGHT CHAIN CDRs

| Ab | Type | CDR 1 | CDR 2 | CDR 3 |
|---|---|---|---|---|
| 14039<br>14302<br>14303 | AA | SGDRLGEKYTS<br>SEQ ID NO: 922 | QDTKRPS<br>SEQ ID NO: 197 | QAWESSTVV<br>SEQ ID NO: 923 |
| 14301 | AA | SGDRLGEKYTC<br>SEQ ID NO: 196 | QDTKRPS<br>SEQ ID NO: 197 | QAWESSTVV<br>SEQ ID NO: 923 |
| 14022<br>14024<br>14025<br>14026<br>14027<br>14028 | AA | RASRQISSSYLA<br>SEQ ID NO: 924 | GPSSRAT<br>SEQ ID NO: 215 | QQYGSSFT<br>SEQ ID NO: 216 |
| 14029 | AA | RASQSISSSYLA<br>SEQ ID NO: 925 | GPSSRAT<br>SEQ ID NO: 215 | QQYGSSFT<br>SEQ ID NO: 216 |

TABLE IVb-continued

LIGHT CHAIN CDRs

| Ab | Type | CDR 1 | CDR 2 | CDR 3 |
|---|---|---|---|---|
| 14058<br>14059 | AA | TGSSSNIGTGYAVH<br>SEQ ID NO: 220 | GNNNRPS<br>SEQ ID NO: 221 | QSYESRLSGWV<br>SEQ ID NO: 926 |
| 14050<br>14051 | AA | TGSSSNIGTGYDVH<br>SEQ ID NO: 250 | GNSNRPS<br>SEQ ID NO: 251 | QSYESSLSGWV<br>SEQ ID NO: 927 |
| 14063 | AA | SGSSSNIGSNFVN<br>SEQ ID NO: 292 | TNNQRPS<br>SEQ ID NO: 293 | ATWDESLQGWV<br>SEQ ID NO: 928 |
| 14064 | AA | SGSSSNIGSNFVN<br>SEQ ID NO: 292 | TNNQRPS<br>SEQ ID NO: 293 | ATYDDSLNGWV<br>SEQ ID NO: 929 |
| 14099 | AA | SGSSSNIGSNFVN<br>SEQ ID NO: 298 | TNNQRPS<br>SEQ ID NO: 299 | ATWDESMQGWV<br>SEQ ID NO: 930 |
| 14100 | AA | SGSSSNIGSNFVN<br>SEQ ID NO: 298 | TNNQRPS<br>SEQ ID NO: 299 | ATYDESMQGWV<br>SEQ ID NO: 931 |
| 14101 | AA | SGSSSNIGSNFVN<br>SEQ ID NO: 298 | TNNQRPS<br>SEQ ID NO: 299 | ATYDDSMNGWV<br>SEQ ID NO: 932 |
| 14096 | AA | SGSSSNIGRNFVN<br>SEQ ID NO: 304 | TNNQRPS<br>SEQ ID NO: 305 | AAWDESLNGWV<br>SEQ ID NO: 933 |
| 14097 | AA | SGSSSNIGRNFVN<br>SEQ ID NO: 304 | TNNQRPS<br>SEQ ID NO: 305 | AAWDESLQGWV<br>SEQ ID NO: 934 |
| 14090<br>14091 | AA | SGSRSNIGSNFVN<br>SEQ ID NO: 310 | TNYQRPS<br>SEQ ID NO: 311 | AVWDESLNGWV<br>SEQ ID NO: 935 |
| 14092 | AA | SGSRSNIGSNFVN<br>SEQ ID NO: 310 | TNYQRPS<br>SEQ ID NO: 311 | AVYDESLQGWV<br>SEQ ID NO: 936 |
| 14085 | AA | SGSRSNIGSNFVN<br>SEQ ID NO: 316 | TNNQRPS<br>SEQ ID NO: 317 | AVYDDSLNGWV<br>SEQ ID NO: 937 |
| 14086<br>14087 | AA | SGSRSNIGSNFVN<br>SEQ ID NO: 316 | TNNQRPS<br>SEQ ID NO: 317 | AVYDESLQGWV<br>SEQ ID NO: 938 |
| 14077<br>14078<br>14304 | AA | SGDRLGEKYVS<br>SEQ ID NO: 939 | QDNKWPS<br>SEQ ID NO: 329 | QAWDSSTVV<br>SEQ ID NO: 330 |
| 14079 | AA | SGDRLGEKYVS<br>SEQ ID NO: 939 | QDNKWPS<br>SEQ ID NO: 329 | QAWESSTVV<br>SEQ ID NO: 940 |
| 14080 | AA | SGDRLGEKYVY<br>SEQ ID NO: 941 | QDNKWPS<br>SEQ ID NO: 329 | QAWDSSTVV<br>SEQ ID NO: 330 |
| 14075 | AA | SGSRSNIGSNFVN<br>SEQ ID NO: 334 | TNNQRPS<br>SEQ ID NO: 335 | ATWDESMQGWV<br>SEQ ID NO: 942 |
| 14076 | AA | SGSRSNIGSNFVN<br>SEQ ID NO: 334 | TNNQRPS<br>SEQ ID NO: 335 | ATYDESMQGWV<br>SEQ ID NO: 943 |

Human and Cynomologous Monkey Cadherin-19 Sequences

TABLE V

| SEQ ID NO. | DESIGNATION | SOURCE | TYPE | SEQUENCE |
|---|---|---|---|---|
| 944 | Human Cadherin-19 | Human | aa | MNCYLLLRFMLGIPLLWPCLGATENSQTKKVKQPVRSHLRVKRGWVNQFFVPEEMNTTSHHIGQLRSDLDNGNNSFQYKLLGAGA GSTFIIDERTGDIYAIQKLDREERSLYILRAQVIDIATGRAVEPESEFVIKVSDINDNEPKFLDEPYEAIVPEMSPEGTLVIQVTA SDADDPSSGNNARLLYSLLQQPYFSVEPTTGVIRISSKMDRELQDEYWVIIQAKDMIGQPGALSGTTSVLIKLSDVNDNKPIFKE SLYRLTVSESAPTGTSIGTIMAYDNDIGENAEMDYSIEEDSQTFDIITNHETQEGIVILKKVDFEHQNHYGIRAKVKNHHVPEQ LMKYHTEASTTFIKIQVEDVDEPPLFLLPYYVFEVFEETPQGSFVGVVSATDPDNRKSPIRYSITRSKVFNINDNGTITTNSLDR EISAWYNLSITATEKYNIEQISSIPLYVQVLNINDHAPEFSQYYETYVCENAGSGQVIQTISAVDRDESIEEHHFYFNLSVEDTNN SSFTIIDNQDNTAVILTNRTGFNLQEEPVFYISILIADNGIPSLITSTNLTIHVCDCGDSGSTQTCYQELVLSMGFKTEVIIAIL ICIMIFGFIFLTLGLKQRRKQILFPEKSEDFRENIFQYDDEGGGEDTEAFDIAELRSSTIMREKTRKTTSAEIRSLYRQSLQV GPDSAIFRKFILEKLEEANTDPCAPPFDSLQTYAFEGTGSLAGSLSSLESAVSDQDESYDLNELGPRFKRLACMFGSAVQSNN |
| 945 | Human Cadherin-19 | Human | nt | atgaactgtattactgctgcgtttatgttggaattcctctcctatggcctgtctggagcaacagaacagaaactctcaaacaa gaaagtcaagcagtgcagtggcattggagatggaacgtggctggctggtgaagtcaggaggaaatgaata cgactagtcatcacatccggccagctaagatctgattagacaatgaacaattcttccagtagaacatagagaaatgaatgct ggaagtacttttatcattgatgaagaacatcgcactgaggctcactactgaggagctgatcaaggagctgagtttgcatcaaagttcggatatcaatgaca agagcccaggtaaagacatcgctactgaaggctgaacctgagtctgagtttgcatcaaagttcggatatcaatgacaatgaagcctatgagtttcatccaggtgacga agtgatgctgacgatccccaagtgctaatactctaaaatgaagaatcgcaagtagtagtttggtaatcattcaaggaagtgtgaatcttcagatgttaatgacaattcagatgttaatgacaat tggctgacggctgtctctgaatctgcaaccactggactctccatgagctgctgtcatgaaataaactagacatagcatatatagacataggaga gaatgaaatggattacagttcgagccagacgattcgcaaacattcaatcatcaagaacttcagatatgacaatagacataggaga ttatattaaaaagaaagtggattttgagcactgcaggtgagcgtgtgctgcaagatcaagaatgaccaatgacaataggaaat ctcatgaagtaccacctgaggcttttgaagttttgaagatgaactcatgttgtagctgctccaataggaaat ctcctactcttcttattactaggagcagaagtgtcaatcatcaatgatgcaatctactaagcaacttcagatcttctgatgctgcttcc gaaatcagtgcttgtacaacctaagtattcagacaacataagcactcagacagtgaccaagacttctagacatactgactcatcgtgcaaatgacaagatatcaatgacaagtctaaactcattacttatctatctgagaacactaacaat gttcagatatcagtgcagtaggaataggagatgaatccataaagaaatgcaagaccatttactcataattcagattctgaagactactgtgtgttggtggatcacagcaaatagaacgaaacagatcttcaggaggaaaggaattttaccttaaaacaacggagaaacaacagatcatccttaaaacaacggagaaacaacagatcttcctgagaaag aattggtaccatataatccctgaagatctgctctaaacagaacgcgtttgactgctttaaaaacaacggagaaacaacagatcttcctgagaaag tgaagattccagaagaaatatatccccatgatgtgaagaagaatacagaggccttgtatatgacagagctga ggagtagtacccatcaatgctgggaacgcaagactcggaaaaccacaagcgctgagatcaggcaagactcggaaaaccacaagcgctgagatcaggcaagactcggaaaaccacaagcgctgagatcaggcaagactcggaaaccacaagcgctgagactcgagttcaagtt ggccccgacagtgccatattcaaggaaattcattctcggggaacacagggtcattagctggatccctgagctcgtatgatcccggtgccccttcctttgattc cctcagaccctacgcttttgagggaacaggggtcgcttttaaaagattagcactgcatgcagttgcatgcatcggtagaagtt gctcagtctacctaatgagtgggaccctcgcttttaaaagattagcactgcatgcatctgtttggttctgcagtgcagtcaaataattag |
| 946 | Cyno Cadherin-19 | Macaca fascicularis | aa | MNCYLLLLPFMLGIPLLWPCLGATENSQTKKVQQPVGSHLRVKRGWVNQPFFVPEEMNTTSHHVGRLRSDLDNGNNSFQYKLLGAGA GSTFIIDERTGDIYAIEKLDREERSLYILDITTGRAVEPESEFVIKVSDINDNEPKFLDEPYEAIVPEMSPEGTLVQVTA SDADDPSSGNNARLLYSLLQQPYFSVEPTTGVIRISSKMDRELQDEYWVIIQAKDMIGQPGALSGTTSVLIKLSDVNDNKPIFKE SLYRLTVSESAPTGTSIGTIMAYDNDIGENAEMDYSIEEDSQTFDIITNHETQEGIVILKKKVNFEHQNHYGIRAKVKNHHVDEQ LMKYHTEASTTFIKIQVEDVDEPPLFLLPYYIFEIFEETPQGSFVGVVSATDPDNRKSPIRYSITRSKVFNIDDNGTITTNSLDR EISAWYNLSITATEKYNIEQISSIPVYVQVLNINDHAPEFSQYYESYVCENAGSGQVIQTISAVDRDESIEEHHFYFNLSVEDTNS SSFTIIDNQDNTAVILTNRTGFNLQEEPIFYISILIADNGIPSLITSTNLTIHVCDCDDSGSTQTCYQELMLSMGFKTEVIIAIL ICIMVIFGFIFLTLGLKQRRKQILFPEKSEDFRENIFRYDEGGGEDTEAFDVAALRSSTIMREKTRKTTSAEIRSLYRSLQV GPDSAIFRKFILEKLEEADTDPCAPPFDSLQTYAFEGTGSLAGSLSSLESAVSDQDESYDLNELGPRFKRLACMFGSAVQSNN |

TABLE V-continued

| SEQ ID NO. | DESIGNATION | SOURCE | TYPE | SEQUENCE |
|---|---|---|---|---|
| 947 | Cyno Cadherin-19 | Macaca fascicularis | nt | ATGAATTGTTATTACTGCTGCCTTTATGTTGGGAATTCTCTCCTATGGCCTTGTCTTGGAGCAACAGAAAACTCTCAAACAAA<br>GAAAGTCCAGCAGCCAGTAGGATCTCATCTGAGAGTGAAGCGTGCTGGGTGTGAACCAATTTTTGTACCAGAGGAAATGAATA<br>CGACTAGTCATCACGTTGGCCGGCTAAGATCTGATTTAGACAATGAAAACAATTCTTTCAGTACAAGCTTTGGAGCTGGAGCT<br>GGAAGTACTTTTATCATTGATGAAAGAACAGGTGACATATGCACATATGAGAACCTTGATAGAGAGGGATCCCTCTACATCTT<br>AAGAGCCCAGGTAATAGAACATTCCTAGATGGATCTGGATGGGCTGTGAACCTGAGTTGTCATCAAAGTTGTCATATCAGACA<br>ATGAACCAAAATTCCTAGATGAACCTTATGAGGCCATTGTACCAGAGATGTCTCCAGAAGGAACATTAGTCATCAGTGACAGCA<br>AGTGATGCTGATGACCCTTCAAGTGGTAAATAATGCTCGTCTCCACACGTCATTACAAGGCCAGCCATATTTTCTGTTGAACC<br>AACAACAGGAGTCATAAGAATATCTTCTAAAATGCAGTGGTAATGGGTATTGGGTAATCATTCAAGCCAAGGACATGA<br>TTGGTCAGCCAGGAGGCTGTGTCGAACAACAGAAACTGCAGATGTTAATGACATAAGCCTATATTTAAAGAA<br>AGTTTATACCGCCTGACGGTCTCTGAATCTGCACCCACTGGGACTTCTTATAGGAACAATCATGCATATGCATAATGACAATAGGAGA<br>GAATGCAGAAATGGATTACAGCATTGGAGCAGACCATTGCACAGACATTTACAGAGCAAAGTTAAAACCATCATGTGATGAGCAG<br>CTCATGAAATACCACCTGAAGCTTCCACCACTTCATTCATTAAGATCCAGGTGGAAGATGTTGATGAGCCTTCTGCCTCCTCTCC<br>GTATTACATATTTTGAAATTTTCTATTACTAGGAGCAAAGTGTTCATATCGATGATAATGGTACAATCACTACAACTAACTGATCGG<br>CTCCTATCAGGTATCTATTATTACTAGGAGCAAAGTTCTATATCGATGATAATGGTACAATCACTACAACTCTTCGATCCCAGTGATGTGCA<br>GAAATCAGTGCTGTTGGTACAACCTAAGTATTACAGCGCCACAGAAAATCATAGCAGATTCTTTCGATCCCCAGTGATGTGCA<br>AGTTCTTAATATCAATGATCATGCTCCTGAGTTCTTCAATATCAAGAGTTATGTTTGTGAAAATGCAGGCTCTCGGTCAGGTAA<br>TTCAGACTATCAGTGCAGTGGATAGAGAATGATCATAGAAGAGCACCATTTTACTTAATCATCTGTAGAAGACACTAACTCT<br>CAAGTTTACACATCTCCATCTAATTGCCGACAATGGAATCCCGTACTTACAAGTACAATAGAACTGGTTTTAACCTTCATGTCTGTGACTGTG<br>CTTCTACATCTCCATCTAATTGCCGACAATGGAATCCCGTACTTACAAGTACAATAGAACTGGTTTTAACCTTCATGTCTGTGACTGTG<br>AGTACAGTGGGAGCCACACAGACCTCCAGGAGCTTTCATTCCTGAAGAAGTCTTTCCATGGGATTCAAGACACAGAAGTCATTGCATTCTC<br>ATTTGCATTATGTAATATTTGGGTTTATTTTTGACTTGGGTTTAAAACAACGAGAAAACAGAGGCCTTTTGACGTAGCAGCCGTGA<br>TGAAGATTTCAGAGAGAATATATTCCGATATGATGACGAAGGGGTGGAGAAGAGATACAGGAGCCTATACAGGCAGTCTTTGCAAGTT<br>GGGCCCCAGACACCATATATGCCAAGACTCAGAAGAGTTCATCCTGAAAAGCTCTGATACTCAGCAGCCAGTGATCATTGCCTGCCCCTCCTTTGATTC<br>CCTCCAGACCTACGCTTTAACGAGTTGGGACCTGCCTCGCTTTAAAAGATTAGCATGCATGTTTGGTTCTGCAGTGCAGTCAAATAATTAG<br>GCTATGATTACCTTAACGAGTTGGGACCTGCCTCGCTTTAAAAGATTAGCATGCATGTTTGGTTCTGCAGTGCAGTCAAATAATTAG |
| 948 | secreted Cadherin-19 ecto-domain (amino acids 1-596) | Human | aa | MNCYLLLRFMLGIPLLWPCLGATENSQTKVKQPVRSHLRVKRGWVWNQFFVPEEMNTTSHHIGQLRSDLDNGNNSFQYKLLGAGA<br>GSTFIIDERTGDIYAIQKLDREERSLYILRAQVIDIATGRAVEPESEFVIKVSDINDNEPKFLDEFYEAIVPEMSPEGTLVIQVTA<br>SDADDPSSGNNARLLYSLLQGQPYFSVEPTTGVIRISSKMDRELQDEYWVIIQAKDMIGQPGALSGTTSVLIKLSDVNDNKPIFKE<br>SLYRLTVSESAPTGTSIGTIMAYDNDIGENAEMDYSIEEDDSQTFDIITNHETQEGIVILKKKVDFEHQNHYGIRAKVKNHHVPEQ<br>LMKYHTEASTTFIKIQVEDVDEPPLLFLPYVFEVFEETPQGSFVGVVSATDPDNRKSPIRYSIITRSKVFNINDNGTIITSNSLDR<br>EISAWTNLSITATEKYNIEQISSIPLYVQVLNINDHAPEFSQYYETYVCENAGSGQVIQTISAVDRDESIEEHHFYFNLSVEDTNN<br>SSFTIIDNQDNTAVILTNRTGFNLQEPPVFYISILIADNGIPSLITSTNTLITIHVCDCGDSGSTQCYQELVLSMGFKTE |
| 949 | secreted Cadherin-19 ecto-domain (amino acids 1-596) | Human | nt | atgaactgttattactgctgcctttatgttgggaattctctcctatggcctgtcttggagcaacagaaaactctcaaacaa<br>gaaagtccagcagccagtgcgatcatgagatctgagagtgaagctgtgctgggtgtgaaccaattttgtaccagaggaatgaata<br>cgactagtcatcacacgttggccggctaagatctgatttagacaatgaaaacaattctttcagtacaagctttggagctggagct<br>ggaagtactttatcattgatgaaagaacaggtgacatatgcacatatgagaacctgtatagagagggatccctctacatctt<br>aagagcccaggtaatagaacattcctagatggatctggatgggctgtgaacctgagttgtcatcaaagttgtcatatcaatgaca<br>atgaaccaaaattcctagatgaacctatgaggccattgtaccagagatgtctccagaaggaacattagtcatcagtgacagca<br>agtgatgctgatgaccctccaagtggtaatgctcgctctccacacgtcattacaaggccagccatattttctgttgaacc<br>aacaacaggagtcataagaatatcttctaaaatgcagtggtaatgggtattggtaatcattcaagccaaggacatga<br>ttggtcagccaggagcgttgtctgaacaacagaaactgcagatgttaatgacataagcctatattttaaagaa<br>agttatacccgctgactgtctctgaatctgcacccactgggacttcttataggaacaatcatgcatattgacatggaga<br>gaatgcagaaatggattacagcattggagcagacccattgcacagaactttgacaaatttgaacctaagcaagaaggaatag<br>ttatataccaggtgacactgattgattgagcctccaacctcacttcattgaagatcccaggtggaagatgttgatgagcctccttcctcctcc<br>atattgtattgaagttttactagagacgaagtgtcaatatcaatgataatggtacaactaccaactgatcgt<br>ctcctatcaggtattctattactaggagcaaagtgtcaatatcaatgataatggtacaactaccaagtgatcgt |

TABLE V-continued

| SEQ ID NO. | DESIGNATION | SOURCE | TYPE | SEQUENCE |
|---|---|---|---|---|
| | | | | gaatcagtgctggtacaacctaagtattacagccacagaagaaatacaatagaacagatctcttgatccactgtatgtgca<br>agttcttaactacatcaatgatcatgctcctggtttctccaatactatgagacttatgttgtgaaaatgcaggcctggtaa<br>tcagactacagtgcagtggatagaataacaagactgaatccattttacttaatctatctgagaacttaaccttcaagttt<br>tcaagtttacaatcatataaagtatcaagatacacaagacttcatttgactaataaaactggtttaaccttcaagaagacctgt<br>cttctacatccaatccatctaatgccgacagaccgcaatgaacccggtcactcaagtacaaaacaccctttaccacctgcttgtcgtgactgtg<br>gtgacagtgggagcacagacctgccagtacacacagagctgtgcttccatggattcaagacagaa |
| 950 | truncated membrane bound form of human cadherin-19 (amino acids 1-624) | Human | aa | MNCYLLLRFMLGIPLLMPCLGATENSQTKKVKQPVRSHLRVKRGWVNQFFVPEEMNTTSHHIGQLRSDLDNGNNSFQYKLLGAGA<br>GSTFIIDERTGDIYAIQKLDREERSLYILRAQVIDIATGRAVEPESEFVIKVSDINDNEPKFLDEPYEAIVPEMSPEGTIGVTA<br>SDADDPSSGNNARLLYSLLQCGQPYFSVEPTTGVIRISSKMDRELQDEYWVIIQAKDMIGQPGALSGTTSVLIKLSDVNDNKPIFKE<br>SLYRLTVSESAPTGTSIGTIMAYDNDIGENAEMDYSIEEDDSQTFDIITNHETQEGIVILKKKVDFEHQNHYGIRAKVKNHHVPEQ<br>LMKYHTEASTTFIKIQVEDVDEPPLFLLPYVFEVFEETPQGSFVGVVSATDPDNRKSPIRYSITRSKVFNINDNGTITTSNSLDR<br>EISAWYNLSITATEKYNIEQLSSIPLYVQVLNINDHAPEFSQYYETYVCENAGSGQVIQTISAIDRDESIEEHHFYNLSVEDTNN<br>SSFTIIDNQDNTAVILTNRTGFNLQEEPVFYISILIADNGIPSLITSTNTLTIIHVCDCGDSGSTQTCYQELVLSMGFKTEVIIAIL<br>ICIMIIFGFIFLTLGLKQRRKQ |
| 951 | truncated membrane bound form of human cadherin-19 (amino acids 1-624) | Human1 | nt | atgaactgtattactgctcgtcgtttatgtggaattctctcctatgcctctcttggagcaacagaactctcaaacaaa<br>gaaagtcaagcagccagtgcgatctcattgagagtgaagcgtggcagtgcaatggacaatggcaatggaatgaata<br>cgactagtcatcacatcggccagctcaagatctgattagacaagtgactatatgccaataaggagtcccaactcggacct<br>ggaagtacttcatgatgaacaagccagacgctactggaatctctgttcagttgctcatcaaagttcgatatcaatgaca<br>aagagcccagtaatgaacctccagagtgaactctatgaggccatttgcaccagagatgctcgagttgaagaactctgagttgctacatcaggtgacgca<br>atgaccaaaatcctctagatgaccctcaagtgtaataaggtcgtctctacagctcacttcaaggccagccattttctgttgaacc<br>agtgatgctgacgatccctaaagatatcctctaaatgtaatctataaggctttaattcacttacagtgatcaaggttctgataacctga<br>aacaacaggagtcataagaatatctctaaaatgataactaagttattaatttaacttcagatgttaatgaccatcgtgatatcttaaaga<br>ttgctcagccaggatgtcctgcaacaagttactaccaccctggatcctcgaatctctggaataacagtctctaggataatgaactaaagaacctataattaagga<br>atgcagaaatgattacagcatgcacatcggaccaccacttaagcctggagaactcctgaaagtgatgagatcctccctt<br>gtatattaaaagaaaagttgggatgaagatttgaagcaccagaccactaagtaagagccaccaagaagtgcaaggagccgaattctgccctcc<br>ctcatgaagtaccaacctgaggctccacccttcattaagtccaggtggacgtattcctgacaccccacagaccacataggaaat<br>ataatgatttgaagtttgaagaaaccccaggatccatttgagctggtgtgtcgccacagacccaagtaaagacaataggaaat<br>ctccatcagtatctcattactagagacagcaaagtgtcaatatcaataccagaaaatcactgagaccacctctcatcaatgctctgatccactgatgtgca<br>gaaatcagtgctggtacaacctaatgatcatcctctgagttcctcagccatcaatatgatgaactgctactggactgtaaaatccaactctctcaggctctggtaa<br>tccagtctaacatcagtagcatgatatcaagatagcaaaccatcttttactatcatgtgaagcaacataacaat<br>tcaagtttacaatccatctaatgacacatagaccctgcttcatttgactaatgaccaagttgaataaccctggagacttgactgt<br>gtgacagtgggagcacacagacctgccagactcgaatccatggttgcttccatggttgcatcactgaactctgactattcatctcc<br>atttgcatatgacatattttgatttttttgacttggtttaaaacaacggagaaaacag |
| 952 | C137897 huCDH19 (44-141) muCDH19 (140-770) | artificial | aa | GWVWNQFFVPEEMNTTSHHIGQLRSDLDNGNNSFQYKLLGAGAGSTFIIDERTGDIYAIQKLDREERSLYILRAQVIDIATGRAVE<br>PESEFVIKVSDINDNEPRFLDEPYEAIVPEMSPEGTFVIKVTANDADDPSTGYHARILYNLERGQPYFSVEPTTGVIRISSKMDRE<br>LQDTYCVIIQAKDMLGQPGALSGTTVSILKLSDINDNKPIFKESFYRTISESAPIGTSGKIMAYDDIGENAEMEYSIEDDSK<br>IFDIIIDNDTQEGIVILKAKVDFEQQSYYGIRAKVKNCHVDEELAPAHVNASTTYIKVQVEDEDEPPVFLLPYYILEIPEGKPYGT<br>IVGTVSATDPDRRQSPMRYLTGSKMPDINDNGTIITTNNMLDREVSAWYNLTVTATETYNVQQISSAHVVQVFNINDNAPEFSQF<br>YETYVCENAESGEIVQIISAIDRDESIEDHHFYFNHSLEDTNNSSFMLTDNQDNTAVILSNRTGFNLKEEPVFYMILLIADNGIPS<br>LTSTNTLTIQVCDCGDSRNTETCANKGLFIMGFRTEAIIAMICVMVIFGFFFLLALKQRRKETLFPEKTEDFRENIFCYDDEG<br>GGEEDSEAFDIVELRQSTVMERKPQRSKSAEIRSLYRQSLQVGPDSAIFRKFILEKLEEANTDPCAPPFDSLQTFAYEGTGSSAG<br>SLSSLASRDTDQEDDFDYLNDLGPRFKRLASMFGSAVQPNN |
| 953 | C137897 huCDH19 | artificial | nt | ggctgggtgtgaaccaattttttgtaccagaggaaatgaatagctggactgactagtcatcacatcggccagctgattagacaa<br>tggaaacaattcttccagtacaagcttttgggagctggacgtaggaaacaggagacatatg |

TABLE V-continued

| SEQ ID NO. | DESIGNATION | SOURCE | TYPE | SEQUENCE |
|---|---|---|---|---|
| | (44-141) muCDH19 (140-770) | | | ccatacagaagcttgatagaggaggacgatccctcacatcttaagagccaggtaatagacatcgctactggaagggctgtggaa<br>cctggtctgagttgtcatcaaagttcggatatcaatgacaatccagattcctagatgaactccagtcctgatgaacattaaaag<br>tgagatgtcccagaactagaacagaggtcaactactttctgttgagccaacaaccaggagtcatcaaggatcctcaactggtatcgcatcc<br>tataccaactagaacgaggcttaccttcaagccagacagctctggcaacacatgtcgtcggaacacaaccgtatcaat<br>ttgcaagctacactggtgtattaatgacaacaagccaatatcaaagaaagttcctaccgcttcactatatctgaatctgcaccattggaa<br>atatttgacataatcattgacaatgcacccaagataggagagtagtatactaaaaagaagttgatttgagcagagactatta<br>tgcattgacagctaaggttaaaaactgcaggtgtgaagcctgcacctgccatgtaaccgtccccaactactacattaaag<br>ttcaagtagaaagatgaagatgaaccctcgtttctcctcttaccatatacactgaaattctcactgaagaacaatatggaaca<br>attgtggggacggttctgccacagaccagatccgaagacaatcctatgagaggtcagtgctggtacaaacttgactgtcacgctactgaa<br>caatgacaatggaacataatcacccatcagccctctctagccccgctctatgctaaaccagcaatgtcccagagttctccaattc<br>catactgtactaacagcctctcagccccgctcttatgcaagctttaacattaacgacaatgtcccagagttctccaattc<br>tatgagactctatgttgtgaaatgctgaatctggtagatctggagtagtcagtgcaattgacatcaagacaacgctgtaa<br>tcaccattttacttactagtagacctggttcaatcttctgaaaggagcctgctcataccttgattctgataacgctgatccctct<br>ctccaagacacaaccctcctaccaagctcttaacattaacgacaatgtcgctaacaagggacttct<br>ctttatcatgggatttcagaacagaggcaataattgcatcatgatgtttatgtaatttgggttttcttttgatcttg<br>ctctgaaacagcgaagaagaagatctatttccagagaagactcttagggagaataatatttgctatgatgaaggc<br>gagtgcggagatcaggaggctgtgatggcggcctcctgcagtgggcccagacgtgccatattcctagggaagcaa<br>gagtcggagaagctgtcaccgaccatgtcgctccccttgattcaacacagacgttcgctatgaggaacaggtcatcagctggc<br>tctctgagctcctctggcatccagagacactgatcaggagggatgacttcgactacctttaatgacctggaccctcgtttaaaagatt<br>agcaagcatgtttggcctctgcagtacaaccaacatag |
| 954 | C137896 huCDH19 (44-249) muCDH19 (248-770) | artificial | aa | GWVWNQPFFVPEMNTTSHHIGQLRSDLDNGNMSFQYKLLGAGAGSTFIIDERTGDIYAIQKLDREERSLYILRAQVIDIATGRAVE<br>PESEFVIKVSDINDNEPKFLDEPYERAIVPEMSPEGTLVIQVTASDADDPSSGNNARLLYSLLQGQPYFSVEPTTGVIRISSKMDRE<br>LQDEYWVIIQAKDMIGQPGALSGTTSVLIKLSDVNDNKPIFKESFYRFTISESAPIGTSIGKIMAYDDIGENAEMEYSIEDDDSK<br>IFDIIIDNDTQEGIVILKKKVPDFEQQSYYGIRAKVKNCHVDEELAPAHVNASTTYIKVQVEDEDPPVFLLPYYILEIPEGKPYGT<br>IVGTVSATDPDRRQSPMRYYLTGSKMPDINDNGTIITTNMLDREVSAWYNLTVTATETYNVQQISAHVYQVFNINDNAPEFSQF<br>YETYVCENAESGEIVQIISAIDRDESIEDHHFYFNHSLEDTNNSSFMLTDNQDNTAVILSNRTGFNLKEEPVFYMILIADNGIPS<br>LTSTNLTIQVCDCGDSRNTETCANKGLLFIMGFRTEAIIAIMICVMVIFGFFFLILALKQRRKETLFPEKTEDFRENIFCYDDEG<br>GGEEDSEAFDIVELRQSTVMRERKPQRSKSAEIRSLYRQSLQVGPDSAIFRKFILEKLEEANTDPCAPPFDSLQTFAYEGTGSSAG<br>SLSSLASRDTDQEDDFDYLNDLGPRFKRLASMFGSAVQPNN |
| 955 | C137896 huCDH19 (44-249) muCDH19 (248-770) | artificial | nt | ggctggtgtggaaccaattcttttgtaccagaggaaatgaataccactagtcatcacatcggccagctagaatctgattagacaa<br>tggaaacaattcttccagtacaaagcttgggagctggagctggaagtactttatcattgataagaacaggtgacatatg<br>ccatacagaagcttgatgagaggacgatccctcacatcttaagagccaggtaatagacatcgctactggaaggggtgtgaa<br>cctgagtctgagttgtcatcaaagttcggatatcaatgacaatccagattcctagatgaactccagtcctgatgaactccactgtgacc<br>agatgtgtccagaggtcaactactttctgttgagccaacaaccaggagtcatcaagggatcattcttaagtggatagag<br>tctcagctcacttcaaggccagccacatattttctgttgacaacaagcctgatcccagtgctaataatgctcgtctcc<br>ctgcaagctagtattggtgaacctcaacaagccatatgatgacaacaagccccaggagttcctgaacaacaagtgtattaat<br>catcaatgagtaattagggaaaattagttcgacaatgcacccaaggagggtggtggtgtatacagaggtcagcagagctatta<br>tggcattgacagctaaggttaaaaactgcaggtgatgaagccttccagatggcccatgtaacgcttccacaactactacattaaag<br>ttcaagtaggagatgaagatgaaccctcgttctctccctcaccatatacactgaaatctcctaaggaaaccatatggaaca<br>attgtggggacggtttctgccacagaccagatccgaagacaatcctagtgaagctccctagagtgacccttatgaggccattgtctg<br>agatgtgtccagaggtcagttctcgatatcaaggtcagcagcagcagcagcagcagcagcagcagcagctcctaa<br>catgacaatgaacatcaccactaccactaaagctgtaagaagatgatgatgatgatgatgatgcaactgaatcaa<br>tatgagcttatgttgtgaaatgtgaatctggagactggagcgggtgaatcgatgcaattcagtacatcagtcgagccatgaaga |

| SEQ ID NO. | DESIGNATION | SOURCE | TYPE | SEQUENCE |
|---|---|---|---|---|
| | | | | tcaccattttacttactactcctggaagacacaaacaactcaagtttatgctaacagacaatcaagtaacacagctgtaa |
| | | | | tctgtaataagaactggtttcaatcttcactactccaagtctgctgtcttctacatgatcattctgattgctgataacggatcccatct |
| | | | | ctcacaagcacaaactctccactactccaagtctgctgactgtggaagacagtagaacacagaaactgtctaacaaggactgctctt |
| | | | | ctttatcatggatctcagaacagaggcaataattgccatcatgatgagctcaggtgtgttatgtaatattttggttttttcttgattcttg |
| | | | | ctctgaaacagcgaagaagactcggaagcttgacaggtctcgagagactcaggagacgttgaggactgtgcatgtgatgataaggc |
| | | | | gcgggagaagaagactcaggagcttgtacaggcagtccctgacaggcagtgagctgacaaagtacacagacgcgttgccctatctgaagaagca |
| | | | | gagtccggagatcaggagctctgtacaggcgtcccctgacaggcagtgagctgacaaagtacacagacgcgttgccctatgcctatgatgaaagc |
| | | | | ttgaagaagcaaacagacagacccatggctgctccccccccccctttgattcactcaggagatcaggttcagccaggcatcagctgc |
| | | | | tctctgagctctgcatccagagacatccaggagacatcaggagcgcctgactactccactccttaagaagaacacaa |
| | | | | agcaagcatgtttggctctgcagtacaaccaacaattag |
| 956 | C137913 muCDH19 (44-139) huCDH19 (142-249) muCDH19 (248-770) | artificial | aa | AWVWRPFVLEMDDIQCVGKLRSDLDNGNNSFQYKLLGIGAGSFSINERTGEICAIQKLDREEKSLYIILRAQVIDTTIGKAVETE SEFVIRVLDINDNEPKFLDEPEYEAIVPEMSPEGTLVIQVTASDADDPSSGNNARLLYSLLQGQPYFSVEPTGVIRISSKMDRELQ DEYWVIIQAKDMIGQPCALSGTTSVLIKLSDVNDNKPIFKESFYRPTISESAPIGTSIGKIMAYDDDIGENAEMEYSIEDDDSKIF DIIIDNDTQEGIVILKKKVDFEQQSYYGIRAKVKNCHVDEELAPAHVNASTTYIKVQVEDEDEPPVFLLPYYILEIPEGKPYGTIV GTVSAIDPDRRQSPMRYLTGSKMFDINDNGTIIITNMLDREVSAMVNLIVTATETYNVQQISSAHVYVQFNINDNAPEFSQFYE TYVCENAESGEIVQIISAIDRDESIEDHHFYFNHSLEDTNNSSFMLTDNQDNTAVILSNRTGFNLKEEPVFYMILIADNGIPSLT STNTLTIQVCDCGDSRNTETCANKGLLFIMGFRTEAIIAIMICVMVIFGFFLILALKQRRKETLFPEKTEDFRENIFCYDDEGGG EEDSRAFDIVELRQSTVMRERKPQRSKSAEIRSLRQSLQVGPDSAIFRKFILEKLEEANTDPCAPPFDSLQTFAVEGTGSSAGSL SSLASRDTDQEDDFDYLNDLGPRFKRLASMFGSAVQPNN |
| 957 | C137913 muCDH19 (44-139) huCDH19 (142-249) muCDH19 (248-770) | artificial | nt | gcctggtgtggagaccattgttgttctcagaagaaatggatgatctcagaagatctgtggaagctaagactgactatgactgactgcca aacaactctttccagtacaagctactgggattggcgtggaagctttagcattaatgaaagaacaagtgaaatatgccatac agaagcttgatagaggaggaaaatccctctactctgagagccaagtaatagacaacctactggaagctgtgaaatatgtg tccgagttgtctcatgaggaagaacagagataattgaatgacaataccctctgaggaagctgtgataatcaatga gctccagaagaacattagtatccaggtgacaaagtgatgcgacatcgccagtgacctcgactctccccctaca gcttacctcaaggcgacaattttctgttgaacaacaaggagtcataagaatatcttcaaaatggataggagaactgcaa gatgagtatggtaatgacaacaagccaatattcaaggcaagtttctcacgcttcactatctgaacagtgtattaattaaact taggacaaatatgacgactgatatgacaacagaggatgtacagatcagtgatgatgattcaaaatattt gacataatcattgacaatgacccaagaggagtagtatactcaagaaagaatgtgatttgagcagagctattagtgcat tagagctaagttgaagatgaaactgccatgtgcccctgtttccctctctaacaatctgcactcgacctgcacaactcgacactatctaaagttcaag gggagcttctgccacagaccagatgagacagcctcctaccatctcctcagaagccaaaagttgatatcaatga caatggaacaatcaccacacaatgtgcagtcgctgcagtctgtacaactgactgtcacagctacgaaacataca atgtacaacagattccttcagccagtggtatgtgaaagtcggtgagacagttcaacaaatgatcatcagcttcccaattctatgag tcttatctattcaatccactctcccggaacaacaaagctcaagttattgcctgaacaacaagtgagtgagctgtaattctga gtaataaactggttcaatcttcaagtctgaactgtgtctctcacagaagatgattgctgataacggatccccatcctcaca gcacaaactcagaagagacaccagaggatctgactctgtatgtcaaacaagaagaaaactgtgctaacaaggactgctctttat aacacaggaagactggaactctattccaagaagacgacttaggacagcagtacaggaagaaagcctcagagaagcaagtgc ggagatcaggagctcgacaccgagtcctctgcagtgggccagacagtgccatatcctaagaaagttgaag ggagcttcctgccaagctgtgcctgagcgatggccacaagacctgtcactcagagcttgacctagaaagttgaag agctctgcatccagagactccaggagacatcaggagcgcctgactactccactccttaaagaagaagatcaca catgtttggctctgcagtacaaccaaccaattag |
| 958 | C137847 muCDH19 (44-139) | artificial | aa | AWVWRPFVLEMDDIQCVGKLRSDLDNGNNSFQYKLLGIGAGSFSINERTGEICAIQKLDREEKSLYIILRAQVIDTTIGKAVETE SEFVIRVLDINDNEPKFLDEPEYEAIVPEMSPEGTLVIQVTASDADDPSSGNNARLLYSLLQGQPYFSVEPTGVIRISSKMDRELQ DEYWVIIQAKDMIGQPGALSGTTSVLIKLSDVNDNKPIFKESLYRLTVSESAPTGTSIGTIMAYDNDIGENAEMDYSIEEDDSQTF |

| SEQ ID NO. | DESIGNATION | SOURCE | TYPE | SEQUENCE |
|---|---|---|---|---|
| | huCDH19 (142-364) muCDH19 (363-770) | | | DIITNHETQEGIVILKKKVDFEHQNHYGIRAKVKNHVPEQLMKYHTEASTFIKIQVEDVDEPPVFLLPYILEIPEGKPYGTIV GTVSATDPDRRQSPMRYLTGSKMPDINDNGTIIITNMLDREVSAWYNLTVTATETYNVQQISSAHVYVQVFNINDNAPEFSQFYE TYVCENAESGEIVQIISAIDRDESIEDHHFYFNHSLEDTNNSSFMLTDNQDNTAVILSNRTGFNLKEEPVFYMILIADNGIPSLT STNTLTIQVCDCGDSRNTETCANKGLLFIMGFRTEAIIAIMICVMVIFGFFLLIALKQRRKETLFPEKTEDFRENIFCYDDEGGG EEDSEAFDIVELRQSTVMRERKPQRSKSAEIRSLYRQSLQVGPDSAIFRKFILEKLEEANTDPCAPPFDSLQTFAYEGTGSSAGSL SSLASRDTDQEDDFDYINDLGPRFKRLASMFGSAVQPNN |
| 959 | C137847 muCDH19 (44-139) huCDH19 (142-364) muCDH19 (363-770) | artificial | nt | gcctggctgggagacccatttgttgttctagaagatgatgatatacaatgtgttgaaagctaagatctgactagacaatgg aaacaactctttccagtacaagcttgccgtggaagcttgtaatgaagaacaggtgaaatatgccatac agaagcttgatagaggaaaaatccctctacattctggagccaggtaatagaaccactattggaaggctggaaactgaa tccgagttgtcatcagagtttggatatcaggtgacagcaaggatgtgacagatcccctcaaggtgactaatgctcgctcctctaca gctactccaaggcccgaccattagttctgtgaacaacaacagagtgcagtcagcaggacatgttcagcgaggccatatcttctgataagaacaactgcaa gatgagtatggtaatcattcaagccatattaaagaaagttatacggtcagaaatgattcagcatggaaggatgttcgacaactttaaact tcagatgttaatgacaatcatggcatatgataatgcatagcaggagaatgcagaacttgattgctcacacacttgaaggaggatcgcaaacatttt gacattactaactaccaagaaggaatgttatattaaaaagaagtgtttaaaaaaggttgatcaccgaaccactacggtat tagagcaaaagttaaaaaccatcatgtccgagcagctcatgaagtaccacactggctccaccactttcattaagactcagg tggaagatgttgataaccctctgtttcctccttactggacagtggacaatctccatggaaggaaaaacatagttatatcaataga ggacggttctgcgacccagatggaagacaataacatctgaagacaatcaactgactactctacactggttgtaacgacatgttgattaacgactac caatggaacaataccactaccatctctcagccatgttatgtgagaagttcagatcagaggagttcagatctcaatgatctagaaaagatctcaattctcatgag atgtacacagatctctttcagccatgtgaatctggaactgagtcgtgagacacaaacactcaagttttatgctaacagaacaatcaagagtcgtaattctga acttatttactttaatcactcctctactatccatccagtcctgactctgtacgtggagacagtgagaacatcagaacttgcctatgctaacagagagagactctgttttaatccttattcttttgctctga agcacaaacactcctactactcaagctgtacagtcctggagggtctgcatgatcgaaaacttaggagaagatatttgcatgcatatggatgatctgatgatgaggcgggg gaagaagactcggaagccttgacatgacctgagctagaacaaagtacagtaatgagaaggaaagccagagaagcaagagtgc ggagatcaggaaggctgtacagcagctcccttcgacagcgtgccatattccagggggaagaaatttatcctagagaagctgaag aagccaacacagacccatgcccttgctcccccccttgattccatcacagactctgcaccttaatgacctggaactgggacccgtcttaaagatagcaag agtcctggcctgcagacgcatgggcctgcgagcacaacactaccaagtag catgttctgcctcgcagtacaacccaacacattag |
| 960 | C137911 muCDH19 (44-247) huCDH19 (250-364) muCDH19 (363-770) | artificial | aa | AWWRPFVLEEMDDIQCVGKLRSDLDNGNNSFQYKLLGIGAGSFSINERTGEICAIQKLDREEKSLYILRAQVIDTTIGKAVETE SEFVIRVLDINDNEPRFLDEPYEAIVPEMSPEGTVFIKVTANDADDPSTGYHARILYNLERGQPYFPSVEPTTGVIRISSKMDRELQ DTYCVIIQAKDMLGQPGALSGTTTVSIKLSDINDNKPIFKESLYRLTVSESAPTGTSIGTIMAYDNDIGENAEMDYSIEEDDSQTF DIITNHETQEGIVILKKKVDFEHQNHYGIRAKVKNHVPEQLMKYHTEASTFIKIQVEDVDEPPVFLLPYILEIPEGKPYGTIV GTVSATDPDRRQSPMRYLTGSKMPDINDNGTIIITNMLDREVSAWYNLTVTATETYNVQQISSAHVYVQVFNINDNAPEFSQFYE TYVCENAESGEIVQIISAIDRDESIEDHHFYFNHSLEDTNNSSFMLTDNQDNTAVILSNRTGFNLKEEPVFYMILIADNGIPSLT STNTLTIQVCDCGDSRNTETCANKGLLFIMGFRTEAIIAIMICVMVIFGFFLLIALKQRRKETLFPEKTEDFRENIFCYDDEGGG EEDSEAFDIVELRQSTVMRERKPQRSKSAEIRSLYRQSLQVGPDSAIFRKFILEKLEEANTDPCAPPFDSLQTFAYEGTGSSAGSL SSLASRDTDQEDDFDYINDLGPRFKRLASMFGSAVQPNN |
| 961 | C137911 muCDH19 (44-247) huCDH19 (250-364) muCDH19 (363-770) | artificial | nt | gcctggctgggagacccatttgttgttctagaagatgatgatatacaatgtgttgaaagctaagatctgactagacaatgg aaacaactctttccagtacaagcttgccgggattgccgtggaagcttgtaatgaacaggtgaaatatgccatac agaagcttgatagaggaaaaatccctctacattctggagccaggtaatagaaccactattggaaggctggaaactgaa tccgagttgtcatcagagtttggatatcaggtgacagcaatgaaccccaggatcctagtaaccatggctatctgagcctgat gtctcagaagaacaggtgacagccaatgacgacgagtcaatgacatcatgtggcctatctcatcgtcatgataggtgcaa acttagaacactgtgaattattcaagccaaggcacatgtccgtcagcgtcggtgacgtgatcgacatcctatacaa gatacactgtgaattattcaagccaaggcacatgtccgtcagcgtcggtgacgtgatcgacatcctatacaa |

TABLE V-continued

| SEQ ID NO. | DESIGNATION | SOURCE | TYPE | SEQUENCE |
|---|---|---|---|---|
| 962 | C137917 muCDH19 (44-362) huCDH19 (365-772) | artificial | aa | gtcagatattaatgacaatagctctatattaaagaaagtttatacgcttgactgtctcgaattcgaccactgggacttcta<br>taggaacaatcatgcatatgatataatgacataggaggaatagcagaaatgattacagcattgaagaggatgattcgcaaacattt<br>gacattattactaatcatgaaactcaagaaggtatatattaaaagaaagtggattttgagcactgaaccactacggtat<br>tagagcaaagtgaaaaaccatcatgtccgagaatccatgagatcctaatctgaagttcctaattcattaagatccag<br>tgaagatgtgaactcctgttcccttaccatatacactcaaattcctgaaggaacaatcctatgaaacaattgt<br>gggacggttctgccagaccactccctgatggaagacaatcctatggatgctcagcatactctacctgaaggcaaaatgttgatatcaatga<br>catgaacaatcagatcctcagccagccatgttatgtacgaaggctcttacattaacgacaatgctcagagttctctcaattctatgag<br>acttactttgtgaaatctgtgaaatcctatgatgatgagtccatagagatcacca<br>tttttacttactcggtcaattccactccctgaagacaacaaactcaagttttatgctaacgacaatcaagtactgtaactgtaattctga<br>gtaatagaactggttcaatctactatccaagctctgactgtggacagtagaacagttgaaacacaagagcctgtctctaacaagggactctctttat<br>catgggatccagagagccatatgccatcagaggtgttcaattattggattttctcttttgatctcttgctctga<br>aacagcgaagagaggactctattcccagagaaagctttaggagagacttagaatcacagacagctttctaggaaaagcctcatgatgatgaaggcgggg<br>gaagagaccaggaggctgtacaggacccctgcaggtgggccagagtgaccacgttctcatatttcgaaattatcctagagaagttgaag<br>ggagatccaggagctgtacaggaccccgcaggtgggccagagcagtccacatttccaaaattatcctagagaaattagcag<br>aagccacacaggactgtgtctcccccctgattcactcagactgttcctatgaggaacagttcatcagctggctctcctg<br>agctcctggcatccagagagacactgatcagaggagtgactcgactacctcaatgacctgggacccgtttaaaagatagcag<br>catgtttggctctgcagtacaaccacaattag |
| | | | | AWWRPFVVLEEMDDIQCVGKLRSDLDNGMNSFQYKLLGIGAGSFSINERTGEICAIQKLDREEKSLYILRAQVIDTTIGKAVETE<br>SEFVIRVLDINDNEPRFLDEPYEAIVPEMSPEGTFVIKVTANDADDPSTGYHARILYNLERGQPYFSVEPTTGVIRISSKMDRELQ<br>DTYCVIIQAKDMLGQPGALSGTTVSIKLSDINDNKPIFKESFYRFTISESAPIGTSIGKIMAYDDDIGNAEMEYSIEDDSKIF<br>DIIIDNDTQEGIVILKKKVDFEQQSYYGIRAKVKNCHVDELAPAHVNASTTYIKVQVEDEDPLFLLPYVFEVFEETPQGSFV<br>GVVSATDPDNRKSPIRYSITRSKVFNINDNGTITTSNSLDREISAWYNLSITATEKYNIEQISSIPLYVQVLNINDHAPERSQYYE<br>TYVCENAGSGQVIQTISAVDRDESIEEHHFYFNLSVEDTNNSSFTIIDNQNTAVLTNRFGFNLQEEPVFYISILIADNGIPSLT<br>STNTLTIHVCDCGDSGSTQTCQYQELVLSMGFKTEVIIALLICIMIIFGFIFLTLGLKQRRKQILFPEKSEDFRENIFQYDDEGGG<br>EEDTEAFDIAELRSSTIMRERKTRKTTSAEIRSLYRQSLQVGPDSAIFRKFILEKEANTDPCAPPFDSLQTYAFEGTGSLAGSL<br>SSLESAVSDQDESYDYLNELGPRFKRLACMPGSAVQSNN |
| 963 | C137917 muCDH19 (44-362) huCDH19 (365-772) | artificial | nt | gctggtgtggagaccattgttgttctcagaagaaatgatgatacaatgtgttgaaagctaagactgactagacaatgg<br>aacaactcttccagtacaagctactggggattgcgctggaagctttagcattaatgaagaacaggtgaaatatgccatac<br>agaagcttgatagagagaacaggaaaatccctctacattctgagagccaggtaatagacaccactattggaaggctgtggaaactgaa<br>tccgagtctcaagatgaccaatgacagacatatgacagcccatgacttgactctccatcagcctctcaatgcatcctctgaaatctctatcaggatcatttgta<br>ggcgtggtgtcaatcaatcactacaagtggccctcctctcctctcatcaggtatctcatcatcaggctgtgtacaacctaagtattacagccacagaaaatacaat<br>ttatgaacagatctccctcgacaagtgacatttctcttgttgaccaagacatgctcagcctgcctgaaccaacacgtatcaattaagct<br>gtcagatactgtaattatgcaatatcaaggagaaatcttcaactcactcaatatcaatcatagaaaccccattggaaacatcaa<br>tagggaaatttatggcatatgatgatgacaccaagaaggatagacacacagggagaatgagttatactaaagaaaggttgatttgagcagcagagctattatggcat<br>tagaagaggagagagcctccttcccctcattctcatccattatgatattatctaggtatttagaacatatactaggagcaaactccaaggatcatttgta<br>ggcgtgctggtcaatcactacaagtggccctcctcatcaggactgtacaactaagtattatcaggctgtctgtatcaactaagtattacagcagaaaatacaa<br>taatgtacaatcagatccttcgtccaagtgacgatcttacactcaatgatcatgcccaagttctcaatgatcatcaggtatctcaggtatctggatcatcaggtggatgaattcaataacagccacca<br>aacttatgttgttgtatcggtgtaattcaaggacaccaacaatcaagttctacaatcaagatacctcgacaactgtcatttga<br>ctaataagaactgttaactcaagagacaccctttccaaatctctctcaagtgctgtcttctacaatcctcatattaatttgccgacaactggggctaccagagatacggagatctcacttaca<br>agtacaaacaccctaccatcgtgctgacgtggtgaccagaggaggcacacagacccacgatcattgtacattgatcatgatgatttcaagtgttggtttaa<br>catggattcaagacgaaagcatcattgctgagaagacgaagatcctgagagacattgaagattcgagatccaatgaaagagagatattccaatgatgaggggtgga |

TABLE V-continued

| SEQ ID NO. | DESIGNATION | SOURCE | TYPE | SEQUENCE |
|---|---|---|---|---|
| | | | | gaagagatacagaggcctttgatatagcagagctgaggagtagtacccatatatgcgggaacgcaagactcggaaccacaagcgc |
| | | | | tgagatcaggagccttatacggtccttgcaagtcagccctccctttgattccctccagactacgctttgagggaacaggtgcattagtcgatcctg |
| | | | | agctcctagaatactgatccgtgtgccctccctttgatcaggatgaaagctatgattaccttaatgagttgggacctcgcttaaaagatagcatg |
| | | | | catgttggttctgcagtgcagtcagtaattag |
| 964 | C137915 muCDH19 (44-461) huCDH19 (464-772) | artificial | aa | AWVWRPFVVLEEMDDIQCVGKLRSDLDNGNNSFQYKLLGIGAGSFSINERTGEICAIQKLDREEKSLYILRAQVIDTTIGKAVETE SEFVIRVLDINDNEPRFLDEPYEAIVPEMSPEGTFVIKVTANDADDPSTGYHARILYNLERGQPYFSVEPTTGVIRISSKMDRELQ DTYCVIIQAKDMLGQPGALSGTTVSIKLSDINDNKPIFKFSFYRFTISESAPIGTSIGKIMAYDDIGENAEMEYSIEDDDSKIF DIIIDNDTQEGIVILKKKVDFEQQSYYGIRAKVKNCHVDEELAPAHVNASTTYIKVQVEDDEPPVFLLPYYILEIPEGKPYGTIV GTVSATDPDRRQSPMRYYLTGSKMFDINDNGTIIITTNMLDREVSAWYNLIVTATETYNVQQISSAHVYVQFNINDHAPEFSQYYE TYVCENAGSGQVIQTISAVDRDESIEHHFYNLSVEDTNNSSFTIIDNQDNTAVILTNRTGFNLQEEPVFYISILIADNGIPSLT STNTLIHVDCGDSGSTQTCQVELVLSMGFKTEVIIAILICIMIFGFIFLTLGLKQRRKQILPEKSEDFRENIFQYDDEGGG EDTEAPDIAELRSSTIMREKTRKTTSAEIRSLIRQSLQVGPDSAIFRKPILEKLEEANTDPCAPPFDSLQTYAPEGTGSLAGSL SSLESAVSDQDESYDYLNELGPRFKRLACMFGSAVQSNN |
| 965 | C137915 muCDH19 (44-461) huCDH19 (464-772) | artificial | nt | gcctggtgtggagacccatttgttcctctagaagaaatgatgatatcaatgtgtgaaagctaagatctgactagcaatgg aaacaactcttccagtactaaggctactggggattgcgctgaaagcctggagtctgagagccaaagtgtccatccatatgctgtccatc agaagcttgatagaggagaaatccctccacttctgagagccaagccaatcctagaggcctataacacacactatgggaagctgtgaactgaa tccgagttgcatccagagttttgatcaagtgtacaaccaatcaataatccagaggcctatacactagtgaaccatgagccatgtagactgagat gtctccagaaggagtcaacatgtcatcaaggtgacaacaacagagtcagagtcatatgatcttcaactgctgctatctcgccatcctataca acttagacgaggtctgttaattattcaagcaacaagcagcatatcaaagagaagttctcaccgcttcactatctgaatctgaacaacaagct gtcagataatgtgtaatgacaacaagcaatatgatgatcaagataggggaagcttgagatcagacatgattgaagatgattcaaaaatattt gacataacataattgacaatgacacccaaggaaggatagttatacttaagagagaagctgattgacgagcgctatatgcat tagagctaaggtaaaactgccatgtgttcctcttccctcgagagctgcccatgtgaaattccactgaaggaaaacatatggaacaattgtg gggacggttctgccaacaataccaccactacagatcgaagaaaccagatgcgacagaggctggtgacaatgccgacaagtcgtcattcga caatgacaacaatactcctctcagccatggtttaacctcagaagaaccttcttctaacctccactaattgcccaacaatcccgtccattaca agtacaacaaccctaccatcctctccctcagcccatgttcgctgacctgcttgtgacagtgggacacacaccagcttgttcagcttgtttc catggattcaagacagaagctcatatttcctgaagatgttgaagatccaataatgaacaccagagagaacatattccaatatgatgaagaggtgga gaagaatacgaggccttagtaagacatataggccgcgggcaactgatccctcctaatcgtgatgaagctatgtatcaccttaatgagttgggacctcgcttaatgagttgggacctcgc agcctcctagaatactgatccgtgtgccctccctttgattccctccagactacgctttgagggaacaggtgcattagtcgatcctg agctcctagaatactgatccgtgtgccctccctttgatcaggatgaaagctatgattaccttaatgagttgggacctcgcttaaaagatagcatg catgttggttctgcagtgcagtcaataattag |
| 966 | C71144 muCDH19 (44-770) | artificial | aa | AWVWRPFVVLEEMDDIQCVGKLRSDLDNGNNSFQYKLLGIGAGSFSINERTGEICAIQKLDREEKSLYILRAQVIDTTIGKAVETE SEFVIRVLDINDNEPRFLDEPYEAIVPEMSPEGTFVIKVTANDADDPSTGYHARILYNLERGQPYFSVEPTTGVIRISSKMDRELQ DTYCVIIQAKDMLGQPGALSGTTVSIKLSDINDNKPIFKFSFYRFTISESAPIGTSIGKIMAYDDIGENAEMEYSIEDDDSKIF DIIIDNDTQEGIVILKKKVDFEQQSYYGIRAKVKNCHVDEELAPAHVNASTTYIKVQVEDDEPPVFLLPYYILEIPEGKPYE GTVSATDPDRRQSPMRYYLTGSKMFDINDNGTIIITTNMLDREVSAWYNLIVTATETYNVQQISSAHVYVQFNLKEEPVYMILIADNGIPSLT |

TABLE V-continued

| SEQ ID NO. | DESIGNATION | SOURCE | TYPE | SEQUENCE |
|---|---|---|---|---|
| 967 | C71144 muCDH19 (44-770) | artificial | nt | gcctgggtgtggagaccattgtgttctgaagaaatggatgatatacaatggtgttggaaagctaagatctgactagacaatgg aaacaactcttccagtacaagctactgggattggcgctggaagctttagcattaatgaaagaacagtgaaatatgccatac agaagctgatagagaggaagaaaatccctctacattctgaagcccaggtaatacacccactattgggaaggctgtggaactgaa tccgagttgtcatcagagtttggatatcaagtgacagccagtgatgatcctcaactggctatcatgtctgactcctataca gtctccagaaggaaacattgtcatcaaggtgcagcagatgctgagcagatgcttcaaggatgccaatcctcaagcgacaccatcaat acttagaacgaggtcaacactactttctgttgagccaacagatgctcgtcagcctgagccgtgtctggaacaaccgtatcaattaagct gatacatactgtaattattcaaccagccaatattcaaagaaagttccaccgcttcactatactgaatctgaacatctgaacatcaa taggaaaattatgcatatgatgatgacacaagggaagaatgcagcagatgcaagatgatcagcattgaagatgattcaaaatattt gacataatcattgacaatgacaccaagaagggatgatattactttaaaaaagaaagttgattttgagcagcagctattatggcat tagagctaagttgaacatgccatgtggatgaagagcttgcactgccatgttcacatattacaactctacactctgaaggaaaaccaaatggaacattgtg gggacggttctgccaagacccagatcgagaacaatctctatgaagtacagcattgaagatcagcttgatgatcaatga caatggaacatatcaccactactactgacagaggcagtgctgtggtacatctgactgtcacagctgcaactgacatcaca atgtacaacagatctcttcagccatgttcagcaagtcttactactagaagccttgtaaggtaacgtcagagattcagtagaagatcatga acttatgtctgaaatgttgaactgggagtaaagcctcaatcatcagtgacacatcagtgagtgagtccagagatgagctccatagatcacca ttttacttttaatcactctctgaagacacaatccaagttttatgctaacaatcaagtaacaactgcaatctaacaatcgttaattctga gtaataagaactggttcaatctactactccaagtctgactgtggagcagtagaaacacagaaactgtctaacaaggactggacttctttat agcacaaacactctcactactccaagtctgactgtggagcagtagaaacacagaaactgtgctaacaaggactgtcttcttat catgggattcagaacagaggctatttccagaagactgcatcatgatgtgtttggaatatttggctatgatgataggcggcggg aacagcgaagaaaggagctcggaagctgaacgtgacaaagtaatgagagcaaggtgcaagaggaaaggcatcagtgagttgc ggagatcagagctgtacaggcagtcccccctgatcactcagacgtttgcctagaggaacaggtgtcatcagctggctctctg agctcctgggcatccagagacccatgctcgaggagacactcgactactgactctgactacccctgtttaaaagatagcaag catgtttggctctgcagacaacccaacaattag |
| 968 | Flag Tag | artificial | aa | DYKDDDDK |
| 969 | Flag Tag | artificial | nt | gactacaaagacgatgacgacaaag |

Bispecific Binding Molecules

TABLE VI

| SEQ ID NO. | DESIGNATION | SOURCE | TYPE | SEQUENCE |
|---|---|---|---|---|
| 970 | CDR-H1 of CDH19 2G6 | artificial | AA | SYGMH |
| 971 | CDR-H2 of CDH19 2G6 | artificial | AA | FIWYDGSNKYYADSVKD |
| 972 | CDR-H3 of CDH19 2G6 | artificial | AA | RAGIIGTIGYYYGMDV |
| 973 | CDR-L1 of CDH19 2G6 | artificial | AA | SGDRLGEKYTC |
| 974 | CDR-L2 of CDH19 2G6 | artificial | AA | QDTKRPS |
| 975 | CDR-L3 of CDH19 2G6 | artificial | AA | QAWDSSTVV |
| 976 | VH of CDH19 2G6 | artificial | NT | CAGGTGCAGCTGGTGGAATCCGGCGGAGGCGTGGTGCAGCCTGGCAGGTCCCTGAGACTGTCTTGCGCCTCCGGCTTCACCTTCTCCAGCTACGGCATGCACTGGGTCCGACAGGCCCCTGGCAAGGGCCTGGAATGGGTGGCCTTCATTTGGTACGACGGCTCCAACAAGTACTACGCCGACTCCGTGAAGGACCGGTTCACCATCTCCCGGGACAACTCCAAGAACACCCTGTACCTGCAGATGAAGTCCCTGCGGGCCGAGGACACCGCCGTGTACTACTGTGCCAGAGGGCCGGCATCATCGGCTACTACTACGGCATGGACGTGTGGGGCCAGGGCACCACCGTGACCGTGTCTAGC |
| 977 | VH of CDH19 2G6 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSS |
| 978 | VL of CDH19 2G6 | artificial | NT | TACGAGCTGACCCAGCCCCCCTCCGTGTCTGTCTCCGTGCTCCCAGACCGCCTCCATCACCTGTTCTGGCGACCGGCTGGGCGAGAAGTACACCTGTTGGTATCAGCAGAAGCCCGGCCAGTCCCCTGTGCTGGTCATCTACCAGGACACCAAGAGGCCCTCCGGCATCCCTGAGCGGTTCTCCGGCTCCAACTCCGGCAACACCGCCACCCTGACCATCTCCGGACTCCAAGCTCTCCAGGCACCATGGACGAGGCCGACTACTACTGCCAGGCCTGGGACTCCTCCACCGTGGTTCGGCGGAGGCACCAAGCTGACCGTGCTG |
| 979 | VL of CDH19 2G6 | artificial | AA | SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVL |
| 980 | VH-VL of CDH19 2G6 | artificial | NT | CAGGTGCAGCTGGTGGAATCCGGCGGAGGCGTGGTGCAGCCTGGCAGGTCCCTGAGACTGTCTTGCGCCTCCGGCTTCACCTTCTCCAGCTACGGCATGCACTGGGTCCGACAGGCCCCTGGCAAGGGCCTGGAATGGGTGGCCTTCATTTGGTACGACGGCTCCAACAAGTACTACGCCGACTCCGTGAAGGACCGGTTCACCATCTCCCGGGACAACTCCAAGAACACCCTGTACCTGCAGATGAAGTCCCTGCGGGCCGAGGACACCGCCGTGTACTACTGTGCCCGGCGGGCCGGCATCATCGGCTACTACTACGGCATGGACGTGTGGGGCCAGGGCACCACCGTGACCGTGTCTTCTTCTGGCGGAGGTGGCTCAGGCGGTGGCTCCGGCCGTCCGGCATCCTCGACGGTTCCGCGCTCCAACTCCGGCAACACCGCCACCCTGACCATCTCCGGACTCCAAGCTCTCCAGGCACCATGGACGAGGCCGACTACTACTGCCAGGCCTGGGACTCCTCCACCGTGGTTCGGCGGAGGCACCAAGCTGACCGTGCTG |
| 981 | VH-VL of CDH19 2G6 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVL |

TABLE VI-continued

| SEQ ID NO. | DESIGNATION | SOURCE | TYPE | SEQUENCE |
|---|---|---|---|---|
| | CDH19 2G6 × I2C | artificial | | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGLIGTIGYYYGMDVWGQGTTVTVSSGGGGSGGGGSGGGGSYELTQPPSVSVSPGQTASITCSGDRLGEKYT CWYQQKPGQSPLLVIYQDTKRPSGIPERFSGSNSGNTATLTISGTQAMDEADYYCQAWDSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSGGGGSQTVTQEPSLTVSPGGTVTLTCGSSTGAVTSGNYPNWV QQKPGQAPRGLIGGTKFLAPGTPARFSGSLLGGKAALTLSGVPQPEDEAEYYCVLWYSNRWVFGGGTKLTVLHHHHHH |
| 983 | CDR-H1 of CDH19 16E2.1 | artificial | AA | SYGMH |
| 984 | CDR-H2 of CDH19 16E2.1 | artificial | AA | VIWYDGSNKYYADSVKG |
| 985 | CDR-H3 of CDH19 16E2.1 | artificial | AA | DGWELSFDY |
| 986 | CDR-L1 of CDH19 16E2.1 | artificial | AA | RASQGISNYLA |
| 987 | CDR-L2 of CDH19 16E2.1 | artificial | AA | AASSLQS |
| 988 | CDR-L3 of CDH19 16E2.1 | artificial | AA | QHYFTYPRT |
| 989 | VH of CDH19 16E2.1 | artificial | NT | CAGGTGCAGCTGGTGGAATCCGGCGGAGGCGTGGTCCAGCCTGGCCGGTCCAGACTGTCTTGCGCCTCCGGCTTCATCTT CTTCCAGCTACGGCATGCACTGGGTCCGACAGGCCCCTGGAAATGGGTGGCCGTGATTTGGTACGACGGCTCCAACA AGTACTACGCCGACTCCGTGAAGGGCCGGTTCACCATCTCCCGGGACAATCTCCAAGAACACCCTGTACCTGCAGATGAACTCCCTG CGGGTGGAAGATACCGCCGTGTACTACTGCGCCAGGGACGGCTGGGAGCTGTCCTTCGATTACTGGGGCCAGGGCACCCTGGTCAC CGTGTCTAGC |
| 990 | VH of CDH19 16E2.1 | artificial | AA | QVQLVESGGGVVQPGRSLRLSCAASGFIFSSYGMHWVRQTPGKGLEWVAVIWYDGSNKYYADSVKGRFTISRDISKNTLYLQMNSL RVEDTAVYYCARDGWELSFDYWGQGTLVTVSS |
| 991 | VL of CDH19 16E2.1 | artificial | NT | GACATCCAGATGACCCAGTCCCCCTCCAGCCTGTCCGCCAGTGGCGACAGAGTGACCATCACCTGTCGCGCCAGCCAGGGCAT CAGCAACTACCTGGCCTGGTACCAGCAGAAGCCCGGCAAGGCCCCCAAGTCCCTGATCTACGCCGCCAGTCCCTGCAGTCCGGCG TGCCCTCCAAGTTCTCCGGCTCTGGCTCCGGCACCGACTTCACCCTGACCATCTCCAGCCTGCAGCCCGAGGACTTCGCCACCTAC TACTGCCAGCACTACTTCACCTACCCCCGGACCTTCGGACAGGGCACCAAGGTGGAAATCAAG |
| 992 | VL of CDH19 16E2.1 | artificial | AA | DIQMTQSPSSLSASVGDRVITCRASQGISNYLAWLQQKPGKAPKSLIYAASSLQSGVPSKFSGSGSGTDFTLTISSLQPEDFATY YCQHYFTYPRTFGQGTKVEIK |
| 993 | VH-VL of CDH19 16E2.1 | artificial | NT | CAGGTGCAGCTGGTGGAATCCGGCGGAGGCGTGGTCCAGCCTGGCCGGTCCAGACTGTCTTGCGCCTCCGGCTTCATCTT CTCCAGCTACGGCATGCACTGGGTCCGACAGGCCCCTGGAAATGGGTGGCCGTGATTTGGTACGACGGCTCCAACA AGTACTACGCCGACTCCGTGAAGGGCCGGTTCACCATCTCCCGGGACATCTCCAAGAACACCCTGTACCTGCAGATGAACTCCCTG CGGGTGGAAGATACCGCCGTGTACTACTGCGCCAGGGACGGCTGGGAGCTGTCCTTCGATTACTGGGGCCAGGGCACCCTGGTCAC CGTGTCTAGCGGAGGCGGAGGAAGTGGACGACGGAGGATCTGGAGGAGGCGGATCAGATCCAGATGACCCAGTCCCCCTCCAGC TGTCCGCCTCCGTGGGCGACAGAGTCCCTGATCTACGCCGCCAGCTCCCTGCAGTCCGGCGTCCCTCCAAGTTCTCCGGCTCTGG CTCCGGCACCGACTTCACCCTGACCATCTCCAGCCTGCAGCCCGAGGACTTCGCCACCTACTACTGCCAGCACTACTTCACCTACCCCCGG ACCTTCGGACAGGGCACCAAGGTGGAAATCAAG |

TABLE VI-continued

| SEQ ID NO. | DESIGNATION | SOURCE | TYPE | SEQUENCE |
|---|---|---|---|---|
| 994 | VH-VL of CDH19 16E2.1 | artificial | AA | QVQLVESGGGVVQPGRSLRLSCAASGFIFSSYGMHWVRQTPGKGLEWVAVIWYDGSNKYADSVKGRFTISRDISKNTLYLQMNSL RVEDTAVYYCARDWELSFDYWGQGTLVTVSSGGGSGGGGSGGGGSDIQMTQSPSSLSASVGDRVTITCRASQGISNYLAWLQQK PGKAPKSLIYAASSLQSVPSKFSGSGSGTDFTLTISSLQPEDFATYYCQHYFTYPRTFGQGTKVEIK |
| 995 | CDH19 16E2.1 x I2C | artificial | | QVQLVESGGGVVQPGRSLRLSCAASGFIFSSYGMHWVRQTPGKGLEWVAVIWYDGSNKYADSVKGRFTISRDISKNTLYLQMNSL RVEDTAVYYCARDWELSFDYWGQGTLVTVSSGGGSGGGGSGGGGSDIQMTQSPSSLSASVGDRVTITCRASQGISNYLAWLQQK PGKAPKSLIYAASSLQSVPSKFSGSGSGTDFTLTISSLQPEDFATYYCQHYFTYPRTFGQGTKVEIKSGGGSEVQLVESGGGLV QPGGSLKLSCAASGFTFNKYAMNWVRQAPGKGLEWVARIRSKYNNYATYYADSVKDRFTISRDDSKNTAYLQMNNLKTEDTAVYYC VRHGNFGNSYISYWAYWGQGTVTVSSGGGSGGGGSGGGGSQTVVTQEPSLTVSPGGTVLTCGSSTGAVTSGNYPNWVQQKPGQ APRGLIGGTKFLAPGTPARFSGSLLGGKAALTLSGVQPEDEAEYYCVLWYSNRWVFGGGTKLTVLHHHHHH |
| 996 | CDR-H1 of CDH19 17H8.2 | artificial | AA | SYYWS |
| 997 | CDR-H2 of CDH19 17H8.2 | artificial | AA | YIYYIGSTNYNPSLKS |
| 998 | CDR-H3 of CDH19 17H8.2 | artificial | AA | DSRYRSGWYDAFDI |
| 999 | CDR-L1 of CDH19 17H8.2 | artificial | AA | RASQSVAGSYLA |
| 1000 | CDR-L2 of CDH19 17H8.2 | artificial | AA | GASSRAT |
| 1001 | CDR-L3 of CDH19 17H8.2 | artificial | AA | QQYGKSPIT |
| 1002 | VH of CDH19 17H8.2 | artificial | NT | CAGGTGCAGCTGCAGGAATCCGGCCCTGGCCTGGTCAAGCCCTCCGAGACACTGTCCCTGACCTGCACCGTGTCCGGCGGCTCCAT CAACTCCTACTACTGGTCCTGGATCCGGCAGCCCTGGCAGCCCTCCGGCAAGGGCCTGGAATGGATCGGCTACATCTACTACATCGGCTCCACCA ACTACAACCCCAGCCTGAAGTCCAGAGTGACCATCTCCGTGGACACCAGTTCTCCCTGAAGCTGTCCTCCGTGACC GCCGCTGACACGGCCGTGTACTACTGCGCCAGAGACTCCCGGTACAGATCCGGGTGGTACGACGCCTTCGACATCTGGGGCCAGGG CACCATGGTCACCGTGTCCTCT |
| 1003 | VH of CDH19 17H8.2 | artificial | AA | QVQLQESGPGLVKPSETLSLTCTVSGGSINSYYWSWIRQPPGKGLEWIGYIYYIGSTNYNPSLKSRVTISVDTSKNQFSLKLSSVT AADTALYYCARDSRYRSGWYDAFDIWGQGTMVTVSS |
| 1004 | VL of CDH19 17H8.2 | artificial | NT | GATATCGTGCTGACCCAGTCCCCAGGCACCCTGTCTCTGAGCCCTGGCGAGAGAGCCACCCTGTCCTGCAGAGCCTCTCAGTCCGT GGCCGGCTCCTACCTGGCTTGGTATCAGCAGAAGCCCGGCCAGGCCCCTCGGCTGCTGATCTCCGGCGCCTCTTCTAGAGCCACCG GCATCCCTGACCGCTTCTCCGGCTCTGGCTCCGGCACCGACTTCACCCTGACCATCAGCCGCCTGGAACCCGAGGACTTCGCCGTG TACTATTGCCAGCAGTACGGCAAGTCCCCCATCACCTTCGGCCAGGGAACCAAGCTGGAAATGAAG |
| 1005 | VL of CDH19 17H8.2 | artificial | AA | DIVLTQSPGTLSLSPGERATLSCRASQSVAGSYLAWYQQKPGQAPRLLISGASSRATGPDRFSGSGSGTDFTLTISRLEPEDFAV YYCQQYGKSPITFGQGTRLEMK |
| 1006 | VH-VL of CDH19 17H8.2 | artificial | NT | CAGGTGCAGCTGCAGGAATCCGGCCCTGGCCTGGTCAAGCCCTCCGAGACACTGTCCCTGACCTGCACCGTGTCCGGCGGCTCCAT CAACTCCTACTACTGGTCCTGGATCCGGCAGCCCTGGCAGCCCTCCGGCAAGGGCCTGGAATGGATCGGCTACATCTACTACATCGGCTCCACCA ACTACAACCCCAGCCTGAAGTCCAGAGTGACCATCTCCGTGGACACCAGTTCTCCCTGAAGCTGTCCTCCGTGACC GCCGCTGACACGGCCCTGTACTACTGCGCCAGAGACTCCCGGTACAGATCCGGGTGGTACGACGCCTTCGACATCTGGGGCCAGGG |

TABLE VI-continued

| SEQ ID NO. | DESIGNATION | SOURCE | TYPE | SEQUENCE |
|---|---|---|---|---|
| 1007 | VH-VL of CDH19 17H8.2 | artificial | AA | CACCATGGTCACCGTCTCCTCAGGTGGCCGAGGCTCTGGCGGAGGTGGAAGCGGAGGCGGGGATCCGATATCGTGCTGACCCAGT CCCCGGCACCCTGTCTCTGAGCCCTGGCCAGAGACGCCACCCTGTCCTGCAGAGCCTCCAGTCCGTGGCCGGCTCCTACCTGGCT TGGTATCAGCAGAAGCCCGGCCAGGCCCCTCGGCTGCTGATCTCCGGGCTCCTTCTAGAGCCACGGCATCCCTGACCGGTTCTC CGGCTCTGCTCCGGCACCGACTTCACCCTGACCATCAGCCGGCTGGAACCCGAGGACTTCGCCGTGTACTATTGCCAGCAGTACG GCAAGTCCCCATCACTTCGCCAGGAGGACCCGGCTGGAAATGAAG |
| 1008 | CDH19 17H8.2 x I2C | artificial | AA | QVQLQESGPGLVKPSETLSLTCTVSGGSINSYYWSWIRQPPGKGLEWIGYIYYIGSTNYNPSLKSRVTISVDTSKNQFSLKLSSVT AADTALYYCARDSRYRSGWYDAFDIWGQGTMVTVSSGGGGSGGGGSGGGGSDIVLTQSPGTLSLSPGERATLSCRASQSVAGSYLA WYQQKPGQAPRLLISGASSRATGIPDRFSGSGSGTDFTLTISRLEPEDFAVYYCQQYGKSPITFGQGTRLEMK |
| 1009 | CDH19 17H8.2 x I2C | artificial |  | QVQLQESGPGLVKPSETLSLTCTVSGGSINSYYWSWIRQPPGKGLEWIGYIYYIGSTNYNPSLKSRVTISVDTSKNQFSLKLSSVT AADTALYYCARDSRYRSGWYDAFDIWGQGTMVTVSSGGGGSGGGGSGGGGSDIVLTQSPGTLSLSPGERATLSCRASQSVAGSYLA WYQQKPGQAPRLLISGASSRATGIPDRFSGSGSGTDFTLTISRLEPEDFAVYYCQQYGKSPITFGQGTRLEMKSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALITLSGVQPEDEAEYYCVLWYSNRWVFGGGTKLTVLHHHHHH |
| 1009 | CDR-H1 of CDH19 19B5.1 | artificial | AA | SYFIH |
| 1010 | CDR-H2 of CDH19 19B5.1 | artificial | AA | IINPISVSTSYAQKFQG |
| 1011 | CDR-H3 of CDH19 19B5.1 | artificial | AA | GGIQLMLHLDY |
| 1012 | CDR-L1 of CDH19 19B5.1 | artificial | AA | SGSRSNIGSNFVN |
| 1013 | CDR-L2 of CDH19 19B5.1 | artificial | AA | TNNQRPS |
| 1014 | CDR-L3 of CDH19 19B5.1 | artificial | AA | ATWDDSMNGWV |
| 1015 | VH of CDH19 19B5.1 | artificial | NT | CAGGTGCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCATTGGGTCCGACAGGCCCCAGGCCAGGGCCTGGAATGGATGGGCATCATCAACCCTATCTCCGTGTCCA CCTCCTACGCCCAGAATTCAGATGGTACCATGACCGTGACCCAGCACCCTCCACCTGTCACCGTGTCATGGAACTGTCCCCTG CGGAGCCAGGACGGCCGTGTACTACTGCGCCAGAGGCGGCATCCAGCTGATGCTGCACCTGGACTATTGGGGCCAGGGCACCCT GGTCACCGTGTCCTCT |
| 1016 | VH of CDH19 19B5.1 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLMLHLDYWGQGTLVTVSS |
| 1017 | VL of CDH19 19B5.1 | artificial | NT | CAGTCTGCCCTGACCCAGCCTCCCTCACCAGCGCCGTGACCATCTCCTGCTCCGGTCCCGCACACCTGGCACCAGCAGCCTCCAACAT CGGCTCCAACTTCGTGAACTGGTACAGACAGCACCCCGGCAGCGCCCCCAAGTGCTGATCTACACCAACAACCAGCGGCCCTCCG GCGTGCCCGACCGGTTCTCTGGCTCAAGTCTGGCTCCAAGTCCGGCCATCTCCGCCTGGGCTGTCCGCAGTCGAGCGAGTCCGAC TACTACTGCGCCACCTGGACGACTCCATGAACGGCTGGGTGTTCGGCGGAGGCACCAAGCTGACCGTGCTG |
| 1018 | VL of CDH19 19B5.1 | artificial | AA | QSALTQPPSTTGTPGQRVTISCSGSRSNIGSNFVNWYKQLPGTAPKVLIYTNNQRPSGVPDRFSGSKSGTSASLAISGLQSEDESD YYCATWDDSMNGWVFGGGTKLTVL |

TABLE VI-continued

| SEQ ID NO. | DESIGNATION | SOURCE | TYPE | SEQUENCE |
|---|---|---|---|---|
| 1019 | VH-VL of CDH19 19B5.1 | artificial | NT | CAGGTGCAGCTGGTGCAGTCTGGCGCCGAAGTGAAGAAACCTGGCGCTCCGTGAAGGTGTCCTGCAAGGTGTCCGGCTACACCTT<br>CACCAGTACTTCATCCACTGGGTCCGACAGGCCCCAGGCCAGGGCCTGGAATGGATGGGCATCATCAACCCTATCTCCGTGTCCA<br>CCTCCTACGCCCAGAAATTCCAGGGCAGAGTGACCATGACCCGGGACACCTCCACCAGCACCGTGTTCATGGAACTGTCCTCCCTG<br>CGGAGCGAGGACACCGCCGTGTACTACTGCGCCAGAGGCATCCAGCTGCTGCACGATTATTGGGGCCAGGGCACCCT<br>GGTCACCGTGTCCTCTGGTGGCGGAGGATCTGGAGGCGGAGGCTCCGGTGGCGGAGGATCTCAGTCTGCCCTGACCCAGCCTCCT<br>CAACCAGCGACACGCCCGGACACCTGCCGCCAGCGCGTGACCATCTCCTGCTCCGGGAGCAGCCCCAACACCAGCGCCTGTCTGGCTC<br>AAGTCTGGCACCTCCCGCTCCACCTGGAACTCCGGCTGACCTGCAGTCGGAGTCGGACTACTACTGTGCCACCTGGGACGACT<br>CCATGAACGGCTGGGTGTTCGGCGGAGGCACCAAGCTGACCGTGCTG |
| 1020 | VH-VL of CDH19 19B5.1 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL<br>RSEDTAVYYCARGIQLWLHLDYWGQGTLVTVSSGGGGSGGGGSQSALTQPPSTTGTPGQRVTISCSGSRSNIGSNFVNWY<br>KQLPGTAPKVLIYTNNQRPSGVPDRFSGSKSGTSASLAISGLQSEDESDYYCATWDDSMNGWVFGGGTKLTVL |
| 1021 | CDH19 19B5.1 x I2C | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL<br>RSEDTAVYYCARGIQLWLHLDYWGQGTLVTVSSGGGGSGGGGSQSALTQPPSTTGTPGQRVTISCSGSRSNIGSNFVNWY<br>KQLPGTAPKVLIYTNNQRPSGVPDRFSGSKSGTSASLAISGLQSEDESDYYCATWDDSMNGWVFGGGTKLTVLSGGGGSEVQLVES<br>GGGLVQPGGSLKLSCAASGFTFNKYAMNWVRQAPGKGLEWVARIRSKYNNVATYYADSVKDRFTISRDDSKNTAYLQMNNLKTEDT<br>AVYYCVRHGNFGNSYISYWAYWGQGTLVTVSSGGGGSGGGGSGGGGSQTVVTQEPSLTVSPGGTVTLTCGSSTGAVTSGNYPNWVQ<br>QKPGQAPRGLLIGGTKFLAPGTPARFSGSLLGGKAALTLSGVQPEDEAEYYCVLWYSNRWVFGGGTKLTVLHHHHHH |
| 1022 | CDR-H1 of CDH19 20D3.1 | artificial | AA | SYFIH |
| 1023 | CDR-H2 of CDH19 20D3.1 | artificial | AA | IINPISVSTSYAQKFQG |
| 1024 | CDR-H3 of CDH19 20D3.1 | artificial | AA | GGIQLMLHFDY |
| 1025 | CDR-L1 of CDH19 20D3.1 | artificial | AA | SGSSSNIGSNFVN |
| 1026 | CDR-L2 of CDH19 20D3.1 | artificial | AA | TNNQRPS |
| 1027 | CDR-L3 of CDH19 20D3.1 | artificial | AA | ATWDDSLNGWV |
| 1028 | VH of CDH19 20D3.1 | artificial | NT | CAGGTGCAGCTGGTGCAGTCTGGCGCCGAAGTGAAGAAACCTGGCGCTCCGTGAAGGTGTCCTGCAAGGTGTCCGGCTACACCTT<br>CACCAGTACTTCATCCACTGGGTCCGACAGGCCCCAGGCCAGGGCCTGGAATGGATGGGCATCATCAACCCTATCTCCGTGTCCA<br>CCTCCTACGCCCAGAAATTCCAGGGCAGAGTGACCATGACCCGGGACACCTCCACCAGCACCGTGTTCATGGAACTGTCCTCCCTG<br>CGGAGCGAGGACACCGCCGTGTACTACTGCGCCAGAGGCGGCATCCAGCTGATGCTGCACTTCGACTACTGGGGCCAGGGCACCCT<br>GGTCACCGTGTCTAGC |
| 1029 | VH of CDH19 20D3.1 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL<br>RSEDTAVYYCARGGIQLMLHFDYWGQGTLVTVSS |
| 1030 | VL of CDH19 20D3.1 | artificial | NT | CAGTCTGCCCTGACCCAGCCTCCTTCGACCCAGCGCGTGACCATCTCCTGCTCCGGCTCCTCCTCCAACAT<br>CGGCTCCAACTTCGTGAACTGGTACAAGCAGCTGCCCGGCACCGCCCCCAAGGTGCTGATCTACACCAACAACCAGCGCCCTCCG |

TABLE VI-continued

| SEQ ID NO. | DESIGNATION | SOURCE | TYPE | SEQUENCE |
|---|---|---|---|---|
| 1031 | VL of CDH19 20D3.1 | artificial | AA | GCGTGCCCGACCGGTTCTCTGGCTCCCAAGTCTGGCACCTCCGCCTCCCTGGCCATTCCGGCCTCAGTCCGAGGACGAGTCCGACTACTACTGTCGCACTGGGACGACTCCCTGAACGGCTGGGTGTTCGGCGGAGGCACCCAAGCTGACCGTGCTG |
| 1032 | VH-VL of CDH19 20D3.1 | artificial | NT | CAGGTGCAGCTGGTGCAGTCTGGCGCCGAAGTGAAGAAACCTGGCGCCTCCGTGAAGGTGTCCTGCAAGGTGTCCGGCTACACCTTCACCAGCTACTTCATCCACTGGGTCCGACAGGCCCCAGGCCAGGGCCTGGAATGGATGGGCATCATCAACCCTATCTCCGTGTCACCTCCTACGCCCAGAAATTCCAGGGCAGAGTGACCATGACCAGGGACACCTCCACCTCCACCGTGTTCATGGAACTGTCCTCCCTGCGGAGCGAGGACACCGCCGTGTACTACTGCGCCCAGAGGCGGCATCCAGCTGTGGCCGCGGAGCCTCACATCGGCTCACTCTGCCCTGACCAGCTCCTTCTGCCACCGGCACCCTGGCCAGCCAGCTCCCTGACCATCTCGTCCCAGGCACCTCAACATCGGCTCACTCTGTGAACTGGTACAAGCAGCTGCCCGGCACCGCCCCCAAGGTGCTGATCTACACCAACAACCAGCGCCCTGGCGTCTCGGCTCCAAGTCTGGCACCTCCGCCTCCCTGGCCATCTCCGGCCTGCAGTCCGAGGACGAGTCCGACTACTACTGTGCCACCTGGGACGACTCCCTGAACGGCTGGGTGTTCGGCGGAGGCACCCAAGCTGACCGTGCTG |
| 1033 | VH-VL of CDH19 20D3.1 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLMLHFDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVL |
| 1034 | CDH19 20D3.1 x I2C | artificial | | QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLMLHFDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSQTVVTQEPSLTVSPGGTVLTCGSSTGAVTSGNYPNWVQQKPGQAPRGLIGGTKFLAPGTPARFSGSLLGGKAALTLSGVPEDEAEYYCVLWYSNRWVFGGGTKLTVLHHHHHH |
| 1035 | CDR-H1 of CDH19 22D1.1 | artificial | AA | SYFIH |
| 1036 | CDR-H2 of CDH19 22D1.1 | artificial | AA | IINPISVSTSYAQKFQG |
| 1037 | CDR-H3 of CDH19 22D1.1 | artificial | AA | GGIQLMLHLDY |
| 1038 | CDR-L1 of CDH19 22D1.1 | artificial | AA | SGSSSNIGSNFVN |
| 1039 | CDR-L2 of CDH19 22D1.1 | artificial | AA | TNNQRPS |
| 1040 | CDR-L3 of CDH19 22D1.1 | artificial | AA | ATWDDSMNGWV |
| 1041 | VH of CDH19 22D1.1 | artificial | NT | CAGGTGCAGCTGGTGCAGTCTGGCGCCGAAGTGAAGAAACCTGGCGCCTCCGTGAAGGTGTCCTGCAAGGTGTCCGGCTACACCTTCACCAGCTACTTCATCCACTGGGTCCGACAGGCCCCAGGCCAGGGCCTGGAATGGATGGGCATCATCAACCCTATCTCCGTGTCACCTCCTACGCCCAGAAATTCCAGGGCAGAGTGACCATGACCCGGGACACCTCCACCTCCACCGTGTTCATGGAACTGTCCTCCCTGCGGAGCGAGGACACCGCCGTGTACTACTGCGCCCAGAGGCGGCATCCAGCTGTGGCTGCACCTGGACTATTGGGGCCAGGGCACCCTGGTCACCGTGTCCTCT |

TABLE VI-continued

| SEQ ID NO. | DESIGNATION | SOURCE | TYPE | SEQUENCE |
|---|---|---|---|---|
| 1042 | VH of CDH19 22D1.1 | artificial | AA | QVQLVQSGAEVKKPGASVRVSCKVSGYTFTSYFIHWVRQAPGQGLEMMGIINPISVSTSYAQKFQGRVTMTRDTSTSTVFMELSSLRSEDTAVYYCARGGIQLWLHLDYWGQGTLVTVSS |
| 1043 | VL of CDH19 22D1.1 | artificial | NT | CAGTCTGCCCTGACCCAGCCTCCTTCCGTCACTCCTACCGGACACCTGGCTCCAAGTGTGACCATCTCCTGCTCCGGCTCACATCCGGCTCCAACTGTGAACTGTACAAGCAGTCCCGGCACCTGCCCGGACACCTGCCTGGACCGTTCTCTGGCTCCAAGTCTGGCACCTCCGCCTCCCTGGCCATCTCCGGCCTCCGATCTTGGGCAGGCCATCTCCGGCTGCGTGCCCACCTGGCTGTGCCCCTGGCGTTCTCTGGCTCCAAGTCTGGCACCTCCGCCTCCCTGGCCATCTCCGGCCTCCGATCTTGGGCAGGCCCCTGCGTGCACCCGGACCAGCAAGCACCTGGCTGAACGGCACCAAGCTGACCGTGCTG |
| 1044 | VL of CDH19 22D1.1 | artificial | AA | QSALTQPPSATGPGQRVTISCSGSSSNIGSNFVNWYKQLPGTAPKVLIYTNNQRPSGSKSGTSASLAISGLQSEDESDYYCATWDDSMNGWVFGGGTKLTVL |
| 1045 | VH-VL of CDH19 22D1.1 | artificial | NT | CAGGTCCAGCTGGTGCAGTCTGGCGCCGAAGTGAAGAAACCTGGCGCCTCCGTGCGGGTGTCCTGCAAGGTGTCCGGCTACACCTTCACCAGCTACTTCATCCACTGGGTCCGACAGGCCCCAGGCCAGGGCCTGGAATGGATGGGCATCATCAACCCTATCTCCGTGTCACCTCCTACGCCCAGAAATTCCAGGGCAGAGTGACCATGACCCGGGACACCTCCACTCACCATCGTCATCGAACTGTCCTCCCTGCGGAGCGAGGACACCGCCGTGTACTACTGCGCCAGAGGCGGCATCCAGCTGGCTGACCCTGAACGGCCAGGGCACCCTGGTCACCGTGTCCTCTGGAGGCGGAGGATCTGGCGGAGGCGGCAGCGGCGGAGGAGGATCTCAGTCTGCCCTGACCCAGCCTCCTTCCGCTACCGGACCTGGCCAGCGGGTCACCATCTCCTGCTCCGGCTCCAACATCGGCTCCAACTTCGTGAACTGGTACAAGCAGCTGCCCGGAACCGCCCCTAAAGTGCTGATCTACACCAACAACCAGCGGCCTTCCGGCTCCAAGTCCGGCACCTCCGCCAGTCTGGCCATCTCCGGCCTCCAGAGCGAGGACGAGTCCGACTACTACTGCGCCACCTGGGACGACTCCATGAACGGCTGGGTGTTCGGCGGAGGCACCAAGCTGACCGTGCTG |
| 1046 | VH-VL of CDH19 22D1.1 | artificial | AA | QVQLVQSGAEVKKPGASVRVSCKVSGYTFTSYFIHWVRQAPGQGLEMMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSATGPGQRVTISCSGSSSNIGSNFVNWYKQLPGTAPKVLIYTNNQRPSGSKSGTSASLAISGLQSEDESDYYCATWDDSMNGWVFGGGTKLTVL |
| 1047 | CDH19 22D1.1 x I2C | artificial | AA | QVQLVQSGAEVKKPGASVRVSCKVSGYTFTSYFIHWVRQAPGQGLEMMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSATGPGQRVTISCSGSSSNIGSNFVNWYKQLPGTAPKVLIYTNNQRPSGSKSGTSASLAISGLQSEDESDYYCATWDDSMNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSPGGTVLTCGSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1048 | CDR-H1 of CDH19 22G10.1 | artificial | AA | SYAMN |
| 1049 | CDR-H2 of CDH19 22G10.1 | artificial | AA | TISGGGANTYYADSVKG |
| 1050 | CDR-H3 of CDH19 22G10.1 | artificial | AA | GGMGGYYYGMDV |
| 1051 | CDR-L1 of CDH19 22G10.1 | artificial | AA | RASQSISSNLA |
| 1052 | CDR-L2 of CDH19 22G10.1 | artificial | AA | GAFTRAT |
| 1053 | CDR-L3 of CDH19 22G10.1 | artificial | AA | QQYNYWPLT |

TABLE VI-continued

| SEQ ID NO. | DESIGNATION | SOURCE | TYPE | SEQUENCE |
|---|---|---|---|---|
| 1054 | VH of CDH19 22G10.1 | artificial | NT | GAGGTGCAGTGCTGCTGGAATCCGGCGGAGGACTGGTGCAGCCTGGCGGCTCCCTGAGACTGTCTTGCGCCGCTCCGGCTTCACCTT CCTACTACGCCGACTCCGTGAAGGGCCGGTTCACCATCTCCTCCGACAACTCCAAGAACACCCTGTACCTGCAGATGAACTCCCTG AGAGCCGCCGACACCGCCGTGTACTACTGTGCAAGGGGCGGCGATGGGCGGCTACTACTACTACGGCATGGATGTGTGGGGCCAGGGCAC CACCGTGACCGTGTCTAGC |
| 1055 | VH of CDH19 22G10.1 | artificial | AA | EVQLLESGGGLVQPGGSLRLSCAASGFTFSSYAMNWVRQAPGKGLEWVSTISGGANTYADSVKGRFTISSDNSKSTLYLQMNSL RAADTAVYHCAKGMGGYYYGMDVWGQGTTVTVSS |
| 1056 | VL of CDH19 22G10.1 | artificial | NT | GAGATCGTGATGACCCAGTCCCCCGTGACCCTGTCCCTGAGCCTGGGCGAGAGAGCCACCCTGTCTTGCCGGGCTCCCAGTCCAT CTCCAGCAACTGGCTGGCTTCCAGACAGAAGCCCGGCCAGTCCCCTGTGATCCTGATCTACGGCGCCTTTACCCGGGCCACCGGCA TCCCTGCCAGAGTGTCTGGCTCCGGCACCGAGTTCACCCTGACCATCAGCTCCCTGCAGTCCGAGGACTTTGCCGTGTAC TACTGCCAGCAGTACAACTACTGGCCCCTGACCTTCGGAGGCGGCACCAAGGTGGAAATCAAG |
| 1057 | VL of CDH19 22G10.1 | artificial | AA | EIVMTQSPVTLSLSLGERATLSCRASQSISSNLAWFQQKPGQAPRLLIYGAFTRATGIPARVSGSGSGTEFTLTISSLQSEDFAVY YCQQYNYWPLTFGGGTKVEIK |
| 1058 | VH-VL of CDH19 22G10.1 | artificial | NT | GAGGTGCAGTGCTGCTGGAATCCGGCGGAGGACTGGTGCAGCCTGGCGGCTCCCTGAGACTGTCTTGCGCCGCTCCGGCTTCACCTT CCTACTACGCCGACTCCGTGAAGGGCCGGTTCACCATCTCCTCCGACAACTCCAAGAACACCCTGTACCTGCAGATGAACTCCCTG AGAGCCGCCGACACCGCCGTGTACTACTGTGCAAGGGGCATGGGCGGCTACTACTACTACGGCATGGATGTGTGGGGCCAGGGCAC CACCGTGACCGTGTCTAGCGGAGGCGGAGGATCTGGCGGCGGAGGCCACCCTGTCTTGCGGGGCCTCCAGTCCATCTCCAGCAACTGGGCTCCTGGCT CCAGAGAAGCCCGGCCAGGCCCCTCGGCTGCTGATCTACGGCGCCTTTACCCGGGCCACCGGCATCCCTGCCAGAGTGTCTGGCTC CGGCACCGAGTTCACCCTGACCATCAGCTCCCTGCAGTCCGAGGACTTTGCCGTGTACTACTGCCAGCAGTACAACTACT GGCCCCTGACCTTCGGAGGCGGCACCAAGGTGGAAATCAAG |
| 1059 | VH-VL of CDH19 22G10.1 | artificial | AA | EVQLLESGGGLVQPGGSLRLSCAASGFTFSSYAMNWVRQAPGKGLEWVSTISGGANTYADSVKGRFTISSDNSKSTLYLQMNSL RAADTAVYHCAKGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIK |
| 1060 | CDH19 22G10.1 x I2C | artificial | AA | EVQLLESGGGLVQPGGSLRLSCAASGFTFSSYAMNWVRQAPGKGLEWVSTISGGANTYADSVKGRFTISSDNSKSTLYLQMNSL RAADTAVYHCAKGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1061 | CDR-H1 of CDH19 23A10.3 | artificial | AA | RYGIH |
| 1062 | CDR-H2 of CDH19 23A10.3 | artificial | AA | VIWYDGSNKYYADSVKG |
| 1063 | CDR-H3 of CDH19 23A10.3 | artificial | AA | RAGIPGTTGYYYGMDV |
| 1064 | CDR-L1 of CDH19 23A10.3 | artificial | AA | SGDRLGEKYVC |

TABLE VI-continued

| SEQ ID NO. | DESIGNATION | SOURCE | TYPE | SEQUENCE |
|---|---|---|---|---|
| 1065 | CDR-L2 of CDH19 23A10.3 | artificial | AA | QDNKWPS |
| 1066 | CDR-L3 of CDH19 23A10.3 | artificial | AA | QAWDSSTVV |
| 1067 | VH of CDH19 23A10.3 | artificial | NT | CAGGTGCAGCTGGTGGAATCCGGCGGAGGCGTGGTGCAGCCTGGCCGGTCCGGTCCTGTCTTGCGCCGCTTCACCTT CTCCAGATACCGGCCATCCACTGGGTCCGACAGGCCCCTGGCAAGGGCCTGGAATGGGTGGCCGTGATTTGGTACGACGGCTCCAACA AGTACTACGCCGACTCCGTGAAGGGCCGGTTCACCATCTCCCGGGACAACTCCAAGAACACCCTGTACCTGCTGATGAACTCCCTG CGGGCCGAGGACTCCGCCGTGTACTACTGTGCCAGAAGGGCCGGACATCCCGGCACCGGCTACTACTACGGCATGGATGTGTG GGGCCAGGGCACCACCGTGACCGTGTCTAGC |
| 1068 | VH of CDH19 23A10.3 | artificial | AA | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSS |
| 1069 | VL of CDH19 23A10.3 | artificial | NT | TACGAGCTGACCCAGCCCCCCTCCGTCTCCGTGTCTCCTGGCCAGACCGCTTCTATCACCTGTTCTGGCGACCGGCTGGGCGAGAA ATACGTGTGGTATCAGCAGAAGCCCGGACAGTCCCCAATCCTGGTGATCTACCAGGACAACAAGTGGCCTCCGGCATCCCTG AGCGGTTCTCCGGCTCCTCCACCGTGGTTCGGCGGAGGCACCAAGCTGACCGTGCTG |
| 1070 | VL of CDH19 23A10.3 | artificial | AA | SYELTQPPSVSVSPGQTASITCSGDRLGEKYVCWYQQKPGQSPILVIYQDNKWPSGIPERFSGSNSGNTATLTISGTQAMDEADYY CQAWDSSTVVFGGGTKLTVL |
| 1071 | VH-VL of CDH19 23A10.3 | artificial | NT | CAGGTGCAGCTGGTGGAATCCGGCGGAGGCGTGGTGCAGCCTGGCCGGTCCGGTCCTGTCTTGCGCCGCTTCACCTT CTCCAGATACCGGCCATCCACTGGGTCCGACAGGCCCCTGGCAAGGGCCTGGAATGGGTGGCCGTGATTTGGTACGACGGCTCCAACA AGTACTACGCCGACTCCGTGAAGGGCCGGTTCACCATCTCCCGGGACAACTCCAAGAACACCCTGTACCTGCTGATGAACTCCCTG CGGGCCGAGGACTCCGCCGTGTACTACTGTGCCAGAAGGGCCGGACATCCCGGCACCGGCTACTACTACGGCATGGATGTGTG GGGCCAGGGCACCACCGTGACCGTGTCTAGCTCCGGTGGCGGTGGCTCTGGCGGTGGCGGAAGCGGTGGCGGAGAAATACGTG TGCTGGTATCAGCAGAAGCCCGGACAGTCCCCAATCCTGGTCATCTACCAGGACAACAAGTGGCCTCCGGCATCCCTGAGCGGTT CTCCGGCTCCAACTCCGGCAACACCGCCACCCTGACCATCTCCGGACACAAGGCCATGGACGAGGCCGACTACTACTGCCAGGCCT GGGACTCCTCCACCGTGGTGTTCGGCGGAGGCACCAAGCTGACCGTGCTG |
| 1072 | VH-VL of CDH19 23A10.3 | artificial | AA | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSSGGGGSGGGGSGGGGSSYELTQPPSVSVSPGQTASITCSGDRLGEKYV CWYQQKPGQSPILVIYQDNKWPSGIPERFSGSNSGNTATLTISGTQAMDEADYYCQAWDSSTVVFGGGTKLTVL |
| 1073 | CDH19 23A10.3 x I2C | artificial | AA | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSSGGGGSGGGGSGGGGSSYELTQPPSVSVSPGQTASITCSGDRLGEKYV CWYQQKPGQSPILVIYQDNKWPSGIPERFSGSNSGNTATLTISGTQAMDEADYYCQAWDSSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1074 | CDR-H1 of CDH19 25F8.1 | artificial | AA | SYYIH |
| 1075 | CDR-H2 of CDH19 25F8.1 | artificial | AA | IINPSGGSTRYAQKFQG |

TABLE VI-continued

| SEQ ID NO. | DESIGNATION | SOURCE | TYPE | SEQUENCE |
|---|---|---|---|---|
| 1076 | CDR-H3 of CDH19 25F8.1 | artificial | AA | GGIQLWLHFDY |
| 1077 | CDR-L1 of CDH19 25F8.1 | artificial | AA | SGSSSNIGRNFVN |
| 1078 | CDR-L2 of CDH19 25F8.1 | artificial | AA | TNNQRPS |
| 1079 | CDR-L3 of CDH19 25F8.1 | artificial | AA | AAWDDSLNGWV |
| 1080 | VH of CDH19 25F8.1 | artificial | NT | CAGGTCAGCTGGTGCAGTCTGGGCGCCGAAGTGAAGAAACCTGGCGCCTCCGTGAAGGTGTCCTGCAAGGCCTCCGGCTACACCTT CACCAGCTACTACATCCACTGGGTCCGACAGGCCCCAGGCCAGGGCCTGGAATGATGGGCATCATCAACCCTTCCGGCGGCTCCA CCGATACGCCCAGAAATTCCAGGGCAGAGTGACCATGACCCGGGACACCTCCACCGTGTTCATGGAACTGTCCTCCCTG CGGAGCGAGGACACCGCCGTGTACTACTGCGCCAGAGGCGGCATCCAGCTGTGGCTGCACTTCGACTACTGGGGCCAGGGCACCCT GGTCACCGTGTCTAGC |
| 1081 | VH of CDH19 25F8.1 | artificial | AA | QVQLVQSGAEVKKPGASVKVSCKASGYTFTSYYIHWVRQAPGQGLEWMGIINPSGGSTRYAQKFQGRVTMTRDTSTSTVFMELSSL RSEDTAVYYCARGGIQLWLHFDYWGQGTLVTVSS |
| 1082 | VL of CDH19 25F8.1 | artificial | NT | CAGTCTGCCCTGACCCAGCCTCCTCTGCAAGTGGTACAAGCAGCTGCCCGGCACCGTGCCCGGACAGTGCTGATCTACACCAACAGCGGCTCCTCCG GCTCCCGACCGGTTCTCTGGCTCCAAGTCTGGCACCTCCGCCAGCCTGGCCATCTCCGGCCTGCAGTCCGAAGACGAGTCCGAC TACTACTGTGCCGCCTGGGATGACTCCCTGAACGGCTGGGTGTTCGGCGGAGGCACCAAGCTGACCGTGCTG |
| 1083 | VL of CDH19 25F8.1 | artificial | AA | QSALTQPPSATGTPGQRVTISCSGSSSNIGRNFVNWYKQLPGTAPKVLIYTNNQRPSGVPDRFSGSKSGTSASLAISGLQSEDESD YYCAAWDDSLNGWVFGGGTKLTVL |
| 1084 | VH-VL of CDH19 25F8.1 | artificial | NT | CAGGTCAGCTGGTGCAGTCTGGGCGCCGAAGTGAAGAAACCTGGCGCCTCCGTGAAGGTGTCCTGCAAGGCCTCCGGCTACACCTT CACCAGCTACTACATCCACTGGGTCCGACAGGCCCCAGGCCAGGGCCTGGAATGATGGGCATCATCAACCCTTCCGGCGGCTCCA CCGATACGCCCAGAAATTCCAGGGCAGAGTGACCATGACCCGGGACACCTCCACCGTGTTCATGGAACTGTCCTCCCTG CGGAGCGAGGACACCGCCGTGTACTACTGCGCCAGAGGCGGCATCCAGCTGTGGCTGCACTTCGACTACTGGGGCCAGGGCACCCT GGTCACCGTGTCTAGCGGAGGCGGAGGATCTGGTGGCGGCGGAAGTGGCGGGGGCGGATCTCAGTCTGCCCTGACCCAGCCTCCTT CTGCCACCGGCACCCCTGGCCAGAGGGTCACCATCTCCTGCAGCGGAAGCAACAACCAGCGCGTCCGGCGTCCCCGACCGGTTCTCTGGCTC AAGCAGCTGGCACCTCCGCCAGCCTGGCCATCTCCGGCCTGCAGTCCGAGGACGAGTCCGACTACTACTGTGCCGCCTGGGACGACT CCCTGAACGGCTGGGTGTTCGGCGGAGGCACCAAGCTGACCGTGCTG |
| 1085 | VH-VL of CDH19 25F8.1 | artificial | AA | QVQLVQSGAEVKKPGASVKVSCKASGYTFTSYYIHWVRQAPGQGLEWMGIINPSGGSTRYAQKFQGRVTMTRDTSTSTVFMELSSL RSEDTAVYYCARGGIQLWLHFDYWGQGTLVTVSSGGGGSGGGGSGGGGSQSALTQPPSATGTPGQRVTISCSGSSSNIGRNFVNWY KQLPGTAPKVLIYTNNQRPSGVPDRFSGSKSGTSASLAISGLQSEDESDYYCAAWDDSLNGWVFGGGTKLTVL |
| 1086 | CDH19 25F8.1 x I2C | artificial | AA | QVQLVQSGAEVKKPGASVKVSCKASGYTFTSYYIHWVRQAPGQGLEWMGIINPSGGSTRYAQKFQGRVTMTRDTSTSTVFMELSSL RSEDTAVYYCARGGIQLWLHFDYWGQGTLVTVSSGGGGSGGGGSGGGGSQSALTQPPSATGTPGQRVTISCSGSSSNIGRNFVNWY KQLPGTAPKVLIYTNNQRPSGVPDRFSGSKSGTSASLAISGLQSEDESDYYCAAWDDSLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |

TABLE VI-continued

| SEQ ID NO. | DESIGNATION | SOURCE | TYPE | SEQUENCE |
|---|---|---|---|---|
| 1087 | CDR-H1 of CDH19 25G10.1 | artificial | AA | GYYWS |
| 1088 | CDR-H2 of CDH19 25G10.1 | artificial | AA | YIYYIGSTNYNPSLKS |
| 1089 | CDR-H3 of CDH19 25G10.1 | artificial | AA | DGSSGWYRWFDP |
| 1090 | CDR-L1 of CDH19 25G10.1 | artificial | AA | RASQSVSSSYLA |
| 1091 | CDR-L2 of CDH19 25G10.1 | artificial | AA | GASSRAT |
| 1092 | CDR-L3 of CDH19 25G10.1 | artificial | AA | QQYGNSPLT |
| 1093 | VH of CDH19 25G10.1 | artificial | NT | CAGGTGCAGCTGCAGGAGTCCGGCCCAGGACTGGTCAAGCCCTCGGCCCAGACACTGTCCCTGACCTGTGTCCGGCGGCTCCAT CTCCGGCTACTACTGGTCTGGATCCGGCAGCCCCCTGGCAGCCCCTGGAATGGATCGGCTACATCTACTACATCGGCTCCACCA ACTACAACCCCAGCCTGAAGTCCAGATCCGTGACCATGTCCGTGGACACCTCCAAGAACCAGTTCTCCCTGAAGCTGTCCTCCGTGACC GCCGCTGACACCGCCGTGTACTACTGCGCCAGAGATGGCTCCTCCGGCTGGTATCGTTGGTTCGACCCCTGGGGCCAGGGCACCCT GGTCACCGTGTCTAGC |
| 1094 | VH of CDH19 25G10.1 | artificial | AA | QVQLQESGPGLVKPSETLSLTCVSGGSISGYYWSWIRQPPGKGLEWIGYIYYIGSTNYNPSLKSRVTMSVDTSKNQFSLKLSSVT AADTAVYYCARDGSSGWYRWFDPWGQGTLVTVSS |
| 1095 | VL of CDH19 25G10.1 | artificial | NT | GAGATCGTGCTGACCCAGTCCCCTGGCACCCTGTCCCTGTCCCCTGGCGAGAGAGCCACCCTGTCCTGCAGAGCCTCCCAGTCCGT GTCCTCCTCCTACCTGGCTTGGTATCAGCAGAAGCCCGGCCAGGCCCCTCGGCTGCTGATCTTCGGCGCTTCCAGCAGAGCCACCG GCATCCCTGACCGGTTCTCCGGCTCTGGCTCCGGCACCGACTTCACCCTGACCATCTCCCGGCTGGAACCCGAGGACTTCGCTGTG TACCACTGCCAGCAGTACGGCAACAGCCCCCTGACCTTCGGCGGAGGCACCAAGGTGGAAATCAAG |
| 1096 | VL of CDH19 25G10.1 | artificial | AA | EIVLTQSPGTLSLSPGERATLSCRASQSVSSSYLAWYQQKPGQAPRLLIFGASSRATGIPDRFSGSGSGTDFTLTISRLEPEDFAV YHCQQYGNSPLTFGGGTKVEIK |
| 1097 | VH-VL of CDH19 25G10.1 | artificial | NT | CAGGTGCAGCTGCAGGAGTCCGGCCCAGGACTGGTCAAGCCCTCGGCCCAGACACTGTCCCTGACCTGTGTCCGGCGGCTCCAT CTCCGGCTACTACTGGTCTGGATCCGGCAGCCCCCTGGCAGCCCCTGGAATGGATCGGCTACATCTACTACATCGGCTCCACCA ACTACAACCCCAGCCTGAAGTCCAGATCCGTGACCATGTCCGTGGACACCTCCAAGAACCAGTTCTCCCTGAAGCTGTCCTCCGTGACC GCCGCTGACACCGCCGTGTACTACTGCGCCAGAGATGGCTCCTCCGGCTGGTATCGTTGGTTCGACCCCTGGGGCCAGGGCACCCT GGTCACCGTGTCTAGCGGAGGCGGAGGATCTGGCGGAGGCGGCTCCGGAGGCGGAGGAAGCGAGATCGTGCTGACCCAGTCCCCTG GCACCCTGTCCCTGTCCCCTGGCGAGAGAGCCACCCTGTCCTGCAGAGCCTCCCAGTCCGTGTCCTCCTCCTACCTGGCTTGGTAT CAGCAGAAGCCCGGCCAGGCCCCTCGGCTGCTGATCTTCGGCGCTTCCAGCAGAGCCACCGGCATCCCTGACCGGTTCTCCGGCTC TGGCTCCGGCACCGACTTCACCCTGACCATCTCCCGGCTGGAACCCGAGGACTTCGCTGTGTACCACTGCCAGCAGTACGGCAACA GCCCCCTGACCTTCGGCGGAGGCACCAAGGTGGAAATCAAG |
| 1098 | VH-VL of CDH19 25G10.1 | artificial | AA | QVQLQESGPGLVKPSETLSLTCVSGGSISGYYWSWIRQPPGKGLEWIGYIYYIGSTNYNPSLKSRVTMSVDTSKNQFSLKLSSVT AADTAVYYCARDGSSGWYRWFDPWGQGTLVTVSSGGGGSGGGGSGGGGSEIVLTQSPGTLSLSPGERATLSCRASQSVSSSYLAWY QQKPGQAPRLLIFGASSRATGIPDRFSGSGSGTDFTLTISRLEPEDFAVHCQQYGNSPLTFGGGTKVEIK |
| 1099 | CDH19 25G10.1 x I2C | artificial | AA | QVQLQESGPGLVKPSETLSLTCVSGGSISGYYWSWIRQPPGKGLEWIGYIYYIGSTNYNPSLKSRVTMSVDTSKNQFSLKLSSVT AADTAVYYCARDGSSGWYRWFDPWGQGTLVTVSSGGGGSGGGGSGGGGSEIVLTQSPGTLSLSPGERATLSCRASQSVSSSYLAWY |

TABLE VI-continued

| SEQ ID NO. | DESIGNATION | SOURCE | TYPE | SEQUENCE |
|---|---|---|---|---|
| | | | | QQKPGQAPRLLIFGASSRATGIPDRFSGSGSGTDFTLTISRLEPEDFAVYHCQQYGNSPLTFGGGTKVEIKSGGGGSEVQLVESGG GLVQPGGSLKLSCAASGFTFNKYAMNWVRQAPGKGLEWVARIRSKYNNATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVEGGGTKLTVLHHHHHH |
| 1100 | CDR-H1 of CDH19 26D1.1 | artificial | AA | SYYMS |
| 1101 | CDR-H2 of CDH19 26D1.1 | artificial | AA | IIHPSGDTTYAQKFQG |
| 1102 | CDR-H3 of CDH19 26D1.1 | artificial | AA | GGIKLMLHFDY |
| 1103 | CDR-L1 of CDH19 26D1.1 | artificial | AA | SGSRSNIGSNFVN |
| 1104 | CDR-L2 of CDH19 26D1.1 | artificial | AA | TNNQRPS |
| 1105 | CDR-L3 of CDH19 26D1.1 | artificial | AA | AVWDDSLNGWV |
| 1106 | VH of CDH19 26D1.1 | artificial | NT | CAGGTGCAGCTGGTGCAGTCTGGCGCCGAAGTGAAGAAACCTGGCGCCTCCGTGAAGGTCTCCTGCAAGGCCTCCGGTACACCTT CACCAGCTACTACATGTCCTGGGTCCGACAGGCCCCAGGCCATCATCCACCCTCTGGCCGCGACA CCACCTACGCCCAGAAATTCCAGGGCAGAGTGACCATGACCCGCGACACCTCCACCTCCACCGTGTATATGGAACTGTCCTCCCTG CGGAGCGAGGACACCGCCGTGTACTACTGCGCCAGAGGCGGCATCAAGCTGTGGCTGCACTTCGACTACTGGGGCCAGGGCACCCT GGTCACCGTGTCTAGC |
| 1107 | VH of CDH19 26D1.1 | artificial | AA | QVQLVQSGAEVKKPGASVKVSCKASRYTFTSYYMSWVRQAPGQGLEWMGIIHPSGDTTYAQKFQGRVTMTGDTSTSTVYMELSSL RSEDTAVYYCARGGIKLWLHFDYWGQGTLVTVSS |
| 1108 | VL of CDH19 26D1.1 | artificial | NT | CATTCCGTGCTGACCCAGTCTCCTTCCGGCTCCGGCACCCCTGGCCAGCGCGTGACCATCTCCTGCTCCGGTTCCCGGTCCAACAT CGGCTCCAACTCTGTATCCAGCGCTGGGATGGGCCATCATCCACCCTCTGGCCGCGACA CGCTGCCCGACCCGGTTCTCTGGCTCCAAGTCTGGCACTGGTGCCAGGCCATCTCCGGCCTGCAGTCTGAGGACGAGGCCGAC TACTACTGTGCCGTGTGGGACGACTCCCTGAACGGCTGGGTGTTCGGCGGAGGCACCAAGCTGACCGTGCTG |
| 1109 | VL of CDH19 26D1.1 | artificial | AA | HSVLTQSPSASGTPGQRVTISCSGSRSNIGSNFVNWYQQLPGTAPKLLIYTNNQRPSGVPDRFSGSKSGTSASLAISGLQSEDEAD YYCAVWDDSLNGWVFGGGTKLTVL |
| 1110 | VH-VL of CDH19 26D1.1 | artificial | NT | CAGGTGCAGCTGGTGCAGTCTGGCGCCGAAGTGAAGAAACCTGGCGCCTCCGTGAAGGTCTCCTGCAAGGCCTCCGGTACACCTT CACCAGCTACTACATGTCCTGGGTCCGACAGGCCCCAGGCCATCATCCACCCTCTGGCCGCGACA CCACCTACGCCCAGAAATTCCAGGGCAGAGTGACCATGACCCGCGACACCTCCACCTCCACCGTGTATATGGAACTGTCCTCCCTG CGGAGCGAGGACACCGCCGTGTACTACTGCGCCAGAGGCGGCATCAAGCTGTGGCTGCACTTCGACTACTGGGGCCAGGGCACCCT GGTCACCGTGTCTAGCGGCGGAGGCGGATCTGGTGGCGGAGGCTCCGGCGGTGGTGGATCCCATTCCGTGCTGACCCAGTCTCCT CCGGCTCCGGCACCCCTGGCCAGCGCGTGACCATCTCCTGCTCCGGTTCCCGGTCCAACATCGGCTCCAACTTCGTGAACTGGTAT CAGCAGCTGCCCGGCACCGCCCCTAAGCTGCTGATCTACACCAACAACCAGCGCCCCTCCGGCGTGCCCGACCGGTTCTCTGGCTC CAAGTCTGGCACCTCCGCCTCCCTGGCCATCTCCGGCCTGCAGTCTGAGGACGAGGCCGACTACTACTGTGCCGTGTGGGACGACT CCCTGAACGGCTGGGTGTTCGGCGGAGGCACCAAGCTGACCGTGCTG |

TABLE VI-continued

| SEQ ID NO. | DESIGNATION | SOURCE | TYPE | SEQUENCE |
|---|---|---|---|---|
| 1111 | VH-VL of CDH19 26D1.1 | artificial | AA | QVQLVQSGAEVKKPGASVKVSCKASRYTFTSYYMSWVRQAPGQGLEWMGIIHPSGDTTYAQKFQGRVTMTGDTSTSTVMELSSL RSEDTAVYYCARGGIKLWLHFDYWQQGTLVTVSSGGGGSGGGGSGGGGSHSVLTQSPSASGTPGQRVTISCSGSRSNIGSNFVNWY QQLPGTAPKLLIYTNNQRPSGVPDRFSGSKSGTSASLAISGLQSEDEADYYCAVWDDSLNGWVFGGGTKLTVL |
| 1112 | CDH19 26D1.1 × I2C | artificial | AA | QVQLVQSGAEVKKPGASVKVSCKASRYTFTSYYMSWVRQAPGQGLEWMGIIHPSGDTTYAQKFQGRVTMTGDTSTSTVMELSSL RSEDTAVYYCARGGIKLWLHFDYWQQGTLVTVSSGGGGSGGGGSGGGGSHSVLTQSPSASGTPGQRVTISCSGSRSNIGSNFVNWY QQLPGTAPKLLIYTNNQRPSGVPDRFSGSKSGTSASLAISGLQSEDEADYYCAVWDDSLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1113 | CDR-H1 of CDH19 26F12.1 | artificial | AA | NYYMS |
| 1114 | CDR-H2 of CDH19 26F12.1 | artificial | AA | IINPSGGDSIYAQKFQG |
| 1115 | CDR-H3 of CDH19 26F12.1 | artificial | AA | GGIQLWLHFDY |
| 1116 | CDR-L1 of CDH19 26F12.1 | artificial | AA | SGSRSNIGSNFVN |
| 1117 | CDR-L2 of CDH19 26F12.1 | artificial | AA | TNYQRPS |
| 1118 | CDR-L3 of CDH19 26F12.1 | artificial | AA | AVWDDSLNGWV |
| 1119 | VH of CDH19 26F12.1 | artificial | NT | CAGGTGCAGCTGGTGCAGTCTGGCGCCGAAGTGAAGAAACCTGGCGCCTCCGTGAAGGTGTCCTGCAAGGCCTCCCGGTACACCTT CACCAGCTACTACATGTCCTGGGTCCGACAGGCCCCAGGCCAGGGCCTGGAATGGATGGGCATCATCAACCCCTCTGGCGGCGACT CCACCTACGCCCAGAAGTTCCAGGGCCGTGACCATGACCGGCGACACCTCCACCTCCACCGTGATGGAACTGTCCTCCCTG CGGAGCGAGGACACCGCCGTGTACTACTGCGCCAGGGCCATCCAGCTGTGCTGCACTTGCACTTGACTACTGGGGCCAGGGCACCCT GGTCACCGTGTCTAGC |
| 1120 | VH of CDH19 26F12.1 | artificial | AA | QVQLVQSGAEVKKPGASVKVSCKASRYTFTNYYMSWVRQAPGQGLEWMGIINPSGGDSTYAQKFQGRVTMTGDTSTSTVMELSSL RSEDTAVYYCARGGIQLWLHFDYWQQGTLVTVSS |
| 1121 | VL of CDH19 26F12.1 | artificial | NT | CAGTCTGTGCTGACCCAGTCCCCTTCCGCTTCCGTGTCCGCCGGCGAGAAACCTGGCCAGCGGGTGACCATCTCCTGCTCCGGTCCCAACAT CGGCTCCAACTTCGTGAACTGGTATCAGCAGCTGCCCGGCACCGCCCCCAAGCTGCTCCTCTATACCAACTACCAGCGCCCTCCG GCTGCCGACCGGTTCTCTGGCTCCAAGTCTGGCACCTCCGCCTCCCTGGCCATCTCCGGACTGTCAGTCTGAGGAGGAGGCCGAC TACTACTGTGCCGTGTGGGACGACTCCCTGAACGGCTGGGTGTTCGGCGGAGGCACCAAGCTGACCGTGCTG |
| 1122 | VL of CDH19 26F12.1 | artificial | AA | QSVLTQSPSASGTPGQKVTISCSGSRSNIGSNFVNWYQQLPGTAPKLLIYTNYQRPSGVPDRFSGSKSGTSASLAISGLQSEDEAD YYCAVWDDSLNGWVFGGGTKLTVL |
| 1123 | VH-VL of CDH19 26F12.1 | artificial | NT | CAGGTGCAGCTGGTGCAGTCTGGCGCCGAAGTGAAGAAACCTGGCGCCTCCGTGAAGGTGTCCTGCAAGGCCTCCCGGTACACCTT CACCAACTACTACATGTCCTGGGTCCGACAGGCCCCAGGCCAGGGCCTGGAATGGATGGGCATCATCAACCCCTCTGGCGGCGACT CCACCTACGCCCAGAAGTTCCAGGGCCGTGACCATGACCGGCGACACCTCCACCTCCACCGTGATGGAACTGTCCTCCCTG CGGAGCGAGGACACCGCCGTGTACTACTGCGCCAGGGGCGGCATCCAGCTGTGGCTGCACTTCGACTACTGGGGCCAGGGCACCCT |

TABLE VI-continued

| SEQ ID NO. | DESIGNATION | SOURCE | TYPE | SEQUENCE |
|---|---|---|---|---|
| 1124 | VH-VL of CDH19 26F12.1 | artificial | AA | GGTCACCGTGTCTAGCGGAGGCGGAGGAGATCTGGTGCGCGAGGCTCCCAGTCTGTGCTGACCCAGTCCCCTT CCGCCTCTGGCCACCCCTGGCCAGAAGTGACCATCTCTGCTCCGCTCCGGTCCAACATCGGCTCCAACTTCGTGAACTGGTAT CGCCAGCTGCCCGGCACCGCCCCCAAGCTGCTGATCTACAACCCTGAGCGCCCTGCCGTCCCCGCTACTGCCCGTGTCTGGCTC CAAGTCTGGCACCTCGGCCCTCTGGCCATCTCCGGCTCCGGTCTGAGGACGAGGCCGACTACTACTGTGCCGTGTGGGACACT CCCTGAACGGCGTGGGTGTTCGGCGGAGGGACCAAGCTGACCGTGCTG | QVQLVQSGAEVKKPGASVKVSCKASRYTFTNYYMSWVRQAPGQGLEWMGIINPSGDSTYAQKFQGRLTMTGDTSTSTVYMELSSL RSEDTAVYYCARGIQLWLHFDYWGQGTLVTVSSGGGGSGGGGSGGGGSQSVLTQPSASGTPGQKVTISCSGSRSNIGSNFVNWY QQLPGTAPKLLIYTNYQRPSGVPDRFSGSKSGTSASLAISGLQSEDEADYYCAVWDDSLNGWVFGGGTKLTVL |
| 1125 | CDH19 26F12.1 x I2C | artificial | AA | QVQLVQSGAEVKKPGASVKVSCKASRYTFTNYYMSWVRQAPGQGLEWMGIINPSGDSTYAQKFQGRLTMTGDTSTSTVYMELSSL RSEDTAVYYCARGIQLWLHFDYWGQGTLVTVSSGGGGSGGGGSGGGGSQSVLTQPSASGTPGQKVTISCSGSRSNIGSNFVNWY QQLPGTAPKLLIYTNYQRPSGVPDRFSGSKSGTSASLAISGLQSEDEADYYCAVWDDSLNGWVFGGGTKLTVLSGGGGSEVQLVES GGGLVQPGGSLKLSCAASGFTFNKYAMNWVRQAPGKGLEWVARIRSKYNNVATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALITLSGVQPEDEAEYYCVLWYSNRWVFGGGTKLTVLHHHHHH |
| 1126 | CDR-H1 of CDH19 4A9 | artificial | AA | GYYWS |
| 1127 | CDR-H2 of CDH19 4A9 | artificial | AA | YFSYSGSTNYNPSLKS |
| 1128 | CDR-H3 of CDH19 4A9 | artificial | AA | NWAFHFDF |
| 1129 | CDR-L1 of CDH19 4A9 | artificial | AA | TGSSSNIGTGYAVH |
| 1130 | CDR-L2 of CDH19 4A9 | artificial | AA | GNNNRPS |
| 1131 | CDR-L3 of CDH19 4A9 | artificial | AA | QSYDSRLSGWV |
| 1132 | VH of CDH19 4A9 | artificial | NT | CAGGTGCAGCTGCAGGAATCTGGCCCTGGCCTGGTCAAGCCCTCTGGCCTCTCCGAGACACTGTCCTGACCTGCACCGTGTCCGGCGGCTCCAT CTCCGGCTACTACTGGTCCTGGATCCGACAGCCCCCTGGCAAGGGCCTGGAATGGTTCGCCTACTTCTCCTACTCCGGCTCCACCA ACTACAACCCCAGCCTGAAGTCCAGAGTGACCCTGTCCGTGGACACCAGTCTCCTGAAGAACCAGTTCTCCCTGAAGCTGTCCTCCGTGACC GCCGCTGACACCGCCGTGTACTACTGCGCCCGGAACTGGGCCTTCCACTTCGATTTCTGGGGCCAGGGCACCCTGGTCACCGTGTC TAGC |
| 1133 | VH of CDH19 4A9 | artificial | AA | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHFDFWGQGTLVTVSS |
| 1134 | VL of CDH19 4A9 | artificial | NT | CAGTCTGTCTGCTGACCCAGCCTCCTCCGTGTCCGGAGCCGGACAGAGTGACCATCTCCTGCACCGGCTCCTCCAGCAACAT CGGCACCGGCTACGCCGTGCACTGGTATCAGCAGTTCCCCGGCACCGCCCCCAAGCTGCTGATCTACGGCAACAACCGGCCCT CCGGCGTCCCAGACCGTTCTGGCTCCAAGTCTGGCACCTCCGCCTCTGTATCACCGGCTGCAGGCTGAGGACGAGGCC GACTACTACTGCCAGTCCTACGACTCCCGGCTGTCCGGGTGTTCGGCGGAGGGACCAAGCTGACCGTGCTG |
| 1135 | VL of CDH19 4A9 | artificial | AA | QSVLTQPPSVSGAPGQRVTISCTGSSSNIGTGYAVHWYQQFPGTAPKLLIYGNNNRPSGVPDRFSGSKSGTSASLAITGLQAEDEA DYYCQSYDSRLSGWVFGGGTKLTVL |

TABLE VI-continued

| SEQ ID NO. | DESIGNATION | SOURCE | TYPE | SEQUENCE |
|---|---|---|---|---|
| 1136 | VH-VL of CDH19 4A9 | artificial | NT | CAGGTCAGTGCAGGAATCCGGCCCTGGCCTGGTCAAGCCCTCCGAGACACTGTCCCTGACCTGCACCGTCTCCGGCGCTCCAT CTCCGGCTACTACTGGTCCTGGATCCGGCAGCCCCTGGCAAGGGCCTGGAATGGTTCGCCTACTTCTCCTACTCCGGTTCCACCA ACTACAACCCCAGCCTGAAGTCCAGAGTGACCATCTCCGTCGATACGTCCAAGAACCAGTTCTCCCTGAAGCTGTCCTCCGTGAC GCCGCTGACACCCGTGACCTGTGCCGTGTATTTCTGCGCCCGGAACTGGGCCTTCCACCCCGATTTCTGGGGCCAGGGCACCCTG TAGCGGAGGCGGAGGATCTGGTGGCGGTGGATCTGGCGGCGGAGGCTCCCAGGCCAACATCGGCAGCAACAACCGGCCCTCCGG CCCTGCCACCGCCCCCAAGCTGCTGATCTACGGCAACAACAACCGGCCCTCCGGCGTCCCTGACCGGTTCTCTGGCTCCAAGTCTGG CACCTCCGCCTCCCTGGCTATCACCGGCCTGCAGGCTGAGGACGAGGCCGACTACTACTGCCAGTCCTACGACTCCCGGCTGTCCG GCTGGGTGTTCGGCGGAGGCACCAAGCTGACCGTGCTG |
| 1137 | VH-VL of CDH19 4A9 | artificial | AA | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHPDFWGQGTLVTVSSGGGGSGGGGSGGGGSQSVLTQPPSVSGAPGQRVTISCTGSSNNIGTYAVHWYQQF PGTAPKLLIYGNNNRPSGVPDRFSGSKSGTSASLAITGLQAEDEADYYCQSYDSRLSGWVFGGGTKLTVL |
| 1138 | CDH19 4A9 x I2C | artificial | AA | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHPDFWGQGTLVTVSSGGGGSGGGGSGGGGSQSVLTQPPSVSGAPGQRVTISCTGSSNNIGTYAVHWYQQF PGTAPKLLIYGNNNRPSGVPDRFSGSKSGTSASLAITGLQAEDEADYYCQSYDSRLSGWVFGGGTKLTVLSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQGTLVTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1139 | CDR-H1 of CDH19 4B10 | artificial | AA | SYDMH |
| 1140 | CDR-H2 of CDH19 4B10 | artificial | AA | VISYDGTNEYYADSVKG |
| 1141 | CDR-H3 of CDH19 4B10 | artificial | AA | ERYFDWSFDY |
| 1142 | CDR-L1 of CDH19 4B10 | artificial | AA | RASQSVSNTYLA |
| 1143 | CDR-L2 of CDH19 4B10 | artificial | AA | GASSRAT |
| 1144 | CDR-L3 of CDH19 4B10 | artificial | AA | QQYSNSWT |
| 1145 | VH of CDH19 4B10 | artificial | NT | CAGGTGCAGCTGGTGGAATCCGGCGGAGGCGTGGTGCAGCCTGGCCGGTCCCTGCGCCTGTCTTGCGCCGCTTCACCTT CTCCAGCTACGACATGCACTGGGTCCGACAGGCCCCTGGCAAGGGCCTGGAATGGGTGGCCGTGATCTCCTACGACGGCACCAACG AGTACTACGCCGACTCCGTGAAGGGCCGGTTCACCATCTCCCGGGACACCTCCAAGAACACCCTGTACCTGCAGATGAACTCCCTG CGGGCCGAGGACACCGCCGTGTACTACTGCGCCAGAGAGCGCTACTTCGACTGGTCCTTCGACTACTGGGGCCAGGGCACCCTGGT GTCCGTGTCTAGC |
| 1146 | VH of CDH19 4B10 | artificial | AA | QVQLVESGGGVVQPGRSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSS |
| 1147 | VL of CDH19 4B10 | artificial | NT | GAGATCGTGCTGACCCAGTCCCCTGCCACCCTGTCCCTGAGCCCTGGCGAGAGAGCCACCCTGTCTTGCCGGGCCTCCCAGTCCGT GTCCAACACCTACCTGGCCTGGTATCAGCAGAAGCCTGGCCAGGCCCCTAGGCTGCTGATCTACGGCGCCTCTTCCAGAGCCACCG |

TABLE VI-continued

| SEQ ID NO. | DESIGNATION | SOURCE | TYPE | SEQUENCE |
|---|---|---|---|---|
| | | | | GCATCCCTGACCGGTTCTCCGGCTCTGGCTCTTGGACCACCATCTCAGCTGCCCTGACCTTCGCCTGTG TACTATTGCCAGCAGTACTCCAACTCCTGGACCTTCGGACAGGGCACCAAGGTGGAAATCAAG |
| 1148 | VL of CDH19 4B10 | artificial | AA | EIVLTQSPGTLSLSPGERATLSCRASQSVSNTYLAWYHQRPGQAPRLLIYGASSRATGIPDRFSGSGSGTDFALTISSLEPEDFAV YYCQQYSNSWTFGQGTKVEIK |
| 1149 | VH-VL of CDH19 4B10 | artificial | NT | CAGGTGCAGCTGGTGGAATCCGGCGGAGGCGTGGTGCAGCCTGGCCGGTCCCTGAGACTGTCTTGCGCCGCTTCCGGCTTCACCTT CTCCAGCTACGACATGCACTGGGTTCCGACAGGCCCCTGGAAGGGCCTGGAATGGGTGGCCGTTATCTCCTACGACGGCAGCAACG AGTACTACGCCGACTCCGTGAAGGGCCGGTTCACCATCTCCCGGGACAACTCCAAGAACACCCTGTACCTGCAGATGAACTCCCTG CGGGCCGAGGACACCGCCGTGTACTACTGCGCCAGAGAGCGGTACTTCGACTGGTCTTCGACTACTGGGGCCAGGGCACCCTGGT GTCCGTGTCTAGCGAGGCCGAGGATCTGTGGCGGTCCGGCGGAGGTCTGGTCGGGCCGAGATCGTGCTGACACTACCTGGCTATCAC CCCTGTCCCTGAGCCTGGCCGGCCCTGGCGAGCGCACCCTGTCTTGCCGGGCCAGCCAGAGCGTGTCCAGCAACACCTACCTGGCA CAGCGCCCTGGCCAGGCCCCTCGCCTGCTGATCTACGGCGCCAGCTCCCGGGCCACCGGCATCCCTGACCGGTTCTCCGGCTCTGG CTCTGGCACCGACTTCGCCCTGACCATCTCCAGCCTGGAACCCGAGGATTTCGCTGTCATATTGCCAGCAGTACTCCAACTCCT GGACCTTCGGACAGGGCACCAAGGTGGAAATCAAG |
| 1150 | VH-VL of CDH19 4B10 | artificial | AA | QVQLVESGGGVVQPGRSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYH QRPGQAPRLLIYGASSRATGIPDRFSGSGSGTDFALTISSLEPEDFAVYYCQQYSNSWTFGQGTKVEIK |
| 1151 | CDH19 4B10 x I2C | artificial | | QVQLVESGGGVVQPGRSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYH QRPGQAPRLLIYGASSRATGIPDRFSGSGSGTDFALTISSLEPEDFAVYYCQQYSNYTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNLKTEDTAVYY CVRHGNFGNSYISNWAYWGQGTLVTVSSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYCVLWYSNRWVFGGGTKLTVLHHHHHH |
| 1152 | CDR-H1 of CDH19 4F3 | artificial | AA | SYDMD |
| 1153 | CDR-H2 of CDH19 4F3 | artificial | AA | VIWYDGSNKYYADSVRG |
| 1154 | CDR-H3 of CDH19 4F3 | artificial | AA | ETGEGNYFDL |
| 1155 | CDR-L1 of CDH19 4F3 | artificial | AA | RASQSVSSSYLA |
| 1156 | CDR-L2 of CDH19 4F3 | artificial | AA | GASSRAT |
| 1157 | CDR-L3 of CDH19 4F3 | artificial | AA | QQYGSSWT |
| 1158 | VH of CDH19 4F3 | artificial | NT | CAGGTGCAGCTGGTGGAATCCGGCGGAGGCGTGGTCAGCCTGGCCGGTCCCTGAGACTGTCTTGTGCCGCCTCCGGCTTCAGCTT CTCCTCCTACGACATGGACTGGGTCCGACAGACCCCGGGCAAGGGCCTGGAATGGGTGGCCGTGATTTGGTACGACGGCTCCAACA AGTACTACGCCGACTCCGTGCGGGGCAGATTCACCATCTCCCGGGACAACTCCAAGAACACCCTGTTTCTGCAGATGAACTCCCTG CGGGTGGAAGATACCGCCGTGTACTACTGCGCCAGAGAGACAGGCGAGGGCTGGTACTTCGACCTGTGGGGCCAGGGCACCCTGGT CACCGTGTCTAGC |

TABLE VI-continued

| SEQ ID NO. | DESIGNATION | SOURCE | TYPE | SEQUENCE |
|---|---|---|---|---|
| 1159 | VH of CDH19 4F3 | artificial | AA | QVQLVESGGGVVQPGRSLRLSCAASGFSSYDMDWVRQTPGKGLEWVAVIWYDGSNKYYADSVRGRFTISRDNSKNTLFLQMNSLRVEDTAVYYCARETGEGWYFDLWGRGTLVTVSS |
| 1160 | VL of CDH19 4F3 | artificial | NT | GAGATCGTGCTGACCCAGTCACCCTGCTCCCTGTCTGTCACCCTGGCGAGAGACCACCTGTCTCTGCAGAGCTCCCAGTCCGTGTCCTCCTCGACCGTCTACCTGCCTGTGATCAGCAGAAGCCCGGCCAGGCCCCTGCTGATTTGGTACGACGGCTCCAACAGCATCCCTGACCCGGTTCTCCGGCTCCTCCCTGGACCTTCACCCTGAGCCATCAGCCGGCTGAAGCGCCTGAGACTTCGCTGTGTACTATTGCCAGCAGTACGGCTCTCCTGGAGCCTTCGGGCCAGGGACCAAGGTGGAAATCAAG |
| 1161 | VL of CDH19 4F3 | artificial | AA | EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIK |
| 1162 | VH-VL of CDH19 4F3 | artificial | NT | CAGGTGCAGCTGGTGGAATCCGGCGGAGGCGTGGTGCAGCCTGGCCGGTCCCTGCGGCTGAGCTGCGCCGCCAGTGGATTTTCCAGCTCCTACGACATGGACTGGGTCCGACAGGCCCCCGGCAAGGGCCTGGAATGGGTGGCCGTGATTTGGTACGACGGCTCCAACAAGTACTACGCCGACTCCGTGCGGGGCAGATTCACCATCTCCCGGGACAACTCCAAGAACACCCTGTTTCTGCAGATGAACTCCCTGCGGGTGGAAGATACCGCCGTGTACTACTGCGCCAGAGAGACAGGCGAGGGCTGGTACTTCGACCTGTGGGGCAGACCCACCCTGGTCACCGTGTCTAGCGGAGGCGGAGGATCTGGTGGCGGTGGTTCTGGCGGCGGAGGCTGCAGGAGCCTCCCAGTTCTCCGAGATCGTGCTGACCCAGTCCCCTGGCACCCTGTCCCTGAGCCCTGGCGAGAGAGCCACCCTGAGCTGTCGCGCCTCCCAGTCCGTGTCCTCCTACCTGGCCTGGTATCAGCAGAAGCCCGGCCAGGCCCCTAGACTTCTCATCTACGGCGCCAGCTCCCGGGCAACCGGCATCCCTGACCGGTTCTCCGGCTCTGGCTCCGGCACCGACTTCACCCTGACCATCAGCCGGCTGGAACCCGAGGACTTCGCTGTGTACTATTGCCAGCAGTACGGCTCTCCTGGAGCCTTCGGCCAGGGGACCAAGGTGGAAATCAAG |
| 1163 | VH-VL of CDH19 4F3 | artificial | AA | QVQLVESGGGVVQPGRSLRLSCAASGFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIK |
| 1164 | CDH19 4F3 x I2C | artificial | AA | QVQLVESGGGVVQPGRSLRLSCAASGFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1165 | CDR-H1 of CDH19 4F7 | artificial | AA | SYSWS |
| 1166 | CDR-H2 of CDH19 4F7 | artificial | AA | YIYYSGSTNYNPSLKS |
| 1167 | CDR-H3 of CDH19 4F7 | artificial | AA | NWAFHFDY |
| 1168 | CDR-L1 of CDH19 4F7 | artificial | AA | TGSSSNIGTGYDVH |
| 1169 | CDR-L2 of CDH19 4F7 | artificial | AA | GNSNRPS |
| 1170 | CDR-L3 of CDH19 4F7 | artificial | AA | QSYDSSLSGWV |

TABLE VI-continued

| SEQ ID NO. | DESIGNATION | SOURCE | TYPE | SEQUENCE |
|---|---|---|---|---|
| 1171 | VH of CDH19 4F7 | artificial | NT | CAGGTGCAGCTGCAGGAATCCGGCCTGGCCCTGGTCAAGCCCTCCGAGACACTGTCCCTGACCTGCACCGTGTCCGGCGGCTCCAT CTCCTCCTACTCTTGGTCCTGGATCCGGCAGCCCCTGGAAGGGCCTGGAATGGATCGGCTACATCTACTACTCCGGCTCCACCA ACTACAACCCCAGCCTGAAGTCCAGATGACCATCTCCCTGGACACCAGTCCAAGAACCAGTTCTCCCTGAAGCTGTCCTCCGTGACC GCCGCTGACACCGCCGTGTACTACTGCGCCCGGAACTGGGCCTTCCACTTCGACTACTGGGGCCAGGGCACCCTGGTCACCGTGTC TAGC |
| 1172 | VH of CDH19 4F7 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSS |
| 1173 | VL of CDH19 4F7 | artificial | NT | CAGTCTGTGCTGACCCAGCCTCCCTCTGTCTGGCCCCTGTGCTGACCATTTCCTGCACCGGTCGACAGTGTCAGTCGGTATCAGCAGAT CGGCACGACGCCCCTGAGTGCTCCCAGGCCACCGTGATCGGCGCCGTGCCTCCTCCCTGCCACCTGGCTATCACCGGGTTCTCCGGCTCCAAGTCTGGCACCTGGCTCCCAGCTGGCCCTCCAAGTCAGCTGGCCCCCTCCTGGCTATCCGCCTGGCAGTAAGTGGCCTGCGGGCAGGTGCACCCGACCGCTGCTGCCAGCTGGCCCCTCAAGTCTGG GACTACTGCCAGTCCTACGACTCCTCCCTGTCCGGCGTGTTCGGCGGAGGCACCAGACTGACCGTGCTG |
| 1174 | VL of CDH19 4F7 | artificial | AA | QSVLTQPPSVSGAPGQRVTISCTGSSNIGTGYDVHWYQQLPGTAPKLLIHGNSNRPSGVPDRFSGSKSGTSASLAITGLQAEDEA DYYCQSYDSSLSGWVFGGGTRLTVL |
| 1175 | VH-VL of CDH19 4F7 | artificial | NT | CAGGTGCAGCTGCAGGAATCCGGCCTGGCCCTGGTCAAGCCCTCCGAGACACTGTCCCTGACCTGCACCGTGTCCGGCGGCTCCAT CTCCTCCTACTCTTGGTCCTGGATCCGGCAGCCCCTGGAAGGGCCTGGAATGGATCGGCTACATCTACTACTCCGGCTCCACCA ACTACAACCCCAGCCTGAAGTCCAGAGTGACCATCTCCCTGGACACCAGTTCCAAGAACCAGTTCTCCCTGAAGCTGTCCTCCGTGACC GCCGCTGACACCGCCGTGTACTACTGCGCCCGGAACTGGGCCTTCCACTTCGACTACTGGGGCCAGGGCACCCTGGTCACCGTGTC TAGCGGAGGCGGAGGATCTGGTGGCGGTGGTTCTGGCGGCGGAGGCTCCCAGCAACATGGCACTGGCACCCGAGGCACCGCCGAAGGC CCCTGGCCAGGCGCCTCGACTGCTGATCCTCCAACCTCAACCGGCCTCCAACTCCAGCTGGCTCCCAAGTCTGG CACCTCCGCTCCCTGGCTATCACCGGCCTCCAGCTGGCCGAGCGACTACTACTGCCAGTCCTACGACTCCTCCCTGTCCG GCTGGGTGTTCGGCGGAGGCACCAGACTGACCGTGCTG |
| 1176 | VH-VL of CDH19 4F7 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSNIGTGYDVHWYQQL PGTAPKLLIHGNSNRPSGVPDRFSGSKSGTSASLAITGLQAEDEADYYCQSYDSSLSGWVFGGGTRLTVL |
| 1177 | CDH19 4F7 x I2C | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSNIGTGYDVHWYQQL PGTAPKLLIHGNSNRPSGVPDRFSGSKSGTSASLAITGLQAEDEADYYCQSYDSSLSGWVFGGGTRLTVLSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1178 | CDR-H1 of CDH19 14039 | artificial | AA | SYGMH |
| 1179 | CDR-H2 of CDH19 14039 | artificial | AA | FIWYEGSNKYYAESVKD |
| 1180 | CDR-H3 of CDH19 14039 | artificial | AA | RAGIIGTIGYYGMDV |
| 1181 | CDR-L1 of CDH19 14039 | artificial | AA | SGDRLGEKYTS |

TABLE VI-continued

| SEQ ID NO. | DESIGNATION | SOURCE | TYPE | SEQUENCE |
|---|---|---|---|---|
| 1182 | CDR-L2 of CDH19 14039 | artificial | AA | QDTKRPS |
| 1183 | CDR-L3 of CDH19 14039 | artificial | AA | QAWESSTVV |
| 1184 | VH of CDH19 14039 | artificial | NT | CAGGTGCAGTTGGTGGAGTCTGGGGGAGGCGTGGTCCAGCCTGGGGGGTCCCTGAGACTCTCCTGTGCAGCTCTGGATTCACCTT CAGTAGCTATGGCATGCACTGGGTCCGCCAGGCTCCAGGCAAGGGGCTGGAGTGGGTGGCATTTATATGGTATGAGGAAGTAATA AATACTATGCAGAGTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAAGGGCCGGTATAATAGGAACTATAGGCTACTACTACGGTATGGACGTCTG GGGCCAAGGGACCACGGTCACCGTCTCTAGT |
| 1185 | VH of CDH19 14039 | artificial | AA | QVQLVESGGGVVQPGGSLRLSCAASGFTFSSYGMHWVRQAPGKGLEWVAFIWYEESNKYYAESVKDRFTISRDNSKNTLYLQMNSL RAEDTAVYYCARRAGIIGTIGYYYGMDVWGQGTTVTVSS |
| 1186 | VL of CDH19 14039 | artificial | NT | TCCTATGAACTGACTCAGCCACCCTCAGTGTCCGTGTCCCCAGGACAGACAGCCAGCATCACCTGCTCTGGAGATAGGTTGGGGA AAAATATACTAGCTGGTATCAGCAGAGGCCAGGCCAGTCCCCTTTGCTGGTCATCTATCAAGATACCAAGCGGCCCTCAGGGATCC CTGAGCGATTCTCTGGCTCCAACTCTGGGTAACACAGCCACTCTGACCATCAGCGGACCCAGGCTATGGATGAGGCTGACTATTAC TGTCAGGCGTGGGAGAGCAGCACTGTGGTATTCGGCGGAGGGACCAAGCTGACCGTCCTA |
| 1187 | VL of CDH19 14039 | artificial | AA | SYELTQPPSVSVSPGQTASITCSGDRLGEKYTSKYQQRPGQSPLLVIYQDTKRPSGIPERFSGSNSGNTATLTISGTQAMDEADYY CQAWESSTVVFGGGTKLTVL |
| 1188 | VH-VL of CDH19 14039 | artificial | NT | CAGGTGCAGTTGGTGGAGTCTGGGGGAGGCGTGGTCCAGCCTGGGGGGTCCCTGAGACTCTCCTGTGCAGCTCTGGATTCACCTT CAGTAGCTATGGCATGCACTGGGTCCGCCAGGCTCCAGGCAAGGGGCTGGAGTGGGTGGCATTTATATGGTATGAGGAAGTAATA AATACTATGCAGAGTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAAGGGCCGGTATAATAGGAACTATAGGCTACTACTACGGTATGGACGTCTG GGGCCAAGGGACCACGGTCACCGTCTCTAGTGGTGGTGGAGGATCGGGTGGCGGAGGGTCTGGAGATGGTTGGGGAAAAATATACT AGCTGGTATCAGCAGAGCCAGGCCAGTCCCCTTTGCTGGTCATCTATCAGCGGACCCAGGCTATGGATGAGGCTGACTCCTGAGCGATT CTCTGGCTCCAACTCTGGTAACACAGCCACTCTGACCATCAGCGGACCCAGGCTATGGATGAGGCTGACTATTACTGTCAGGCGT GGGAGAGCAGCACTGTGGTATTCGGCGGAGGGACCAAGCTGACCGTCCTA |
| 1189 | VH-VL of CDH19 14039 | artificial | AA | QVQLVESGGGVVQPGGSLRLSCAASGFTFSSYGMHWVRQAPGKGLEWVAFIWYEESNKYYAESVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVL |
| 1190 | CDH19 14039 x I2C | artificial | AA | QVQLVESGGGVVQPGGSLRLSCAASGFTFSSYGMHWVRQAPGKGLEWVAFIWYEESNKYYAESVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1191 | CDR-H1 of CDH19 14304 | artificial | AA | SYGMH |
| 1192 | CDR-H2 of CDH19 14304 | artificial | AA | FIWYDGSNKYYADSVKD |

TABLE VI-continued

| SEQ ID NO. | DESIGNATION | SOURCE | TYPE | SEQUENCE |
|---|---|---|---|---|
| 1193 | CDR-H3 of CDH19 14304 | artificial | AA | RAGIIGTIGYYYGMDV |
| 1194 | CDR-L1 of CDH19 14304 | artificial | AA | SGDRLGEKYVS |
| 1195 | CDR-L2 of CDH19 14304 | artificial | AA | QDNKWPS |
| 1196 | CDR-L3 of CDH19 14304 | artificial | AA | QAWDSSTVV |
| 1197 | VH of CDH19 14304 | artificial | NT | CAGGTCAGTTGTGGAGTCTGGGGAGGCGTGGTCCAGCCTGGGGGGTCCCTGAGACTCTCCTGTGCAGCGTCTGGATTCACCTT CAGTAGCTATGGCATGCACTGGGTCCGCCAGGCTCCAGGCAAGGGGCTGGAGTGGGTGGCATTTATATGTATGATGAAGTAATA AATACTATGCAGACTCCGTGAAGGACCGATTCACCATCTCCAGAGACAATTCCAAGAACACGCTGTATCTGCAAATGAAAAGCCTG AGAGCTGAGGACACGGCTGTGTATTACTGTGCGAGAGGGCCGGTATAATAGGAACTATAGGCTACTACTACGGTATGGACGTCTG GGGCCAAGGGACCACGGTCACCGTCTCTAGT |
| 1198 | VH of CDH19 14304 | artificial | AA | QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSS |
| 1199 | VL of CDH19 14304 | artificial | NT | TCCTATGAGCTGACTCAGCCACCCTCAGTTCCGTGTCCAGGCTGTCCCTGGAGTCTGGGGACCACCTCAGATCTCTTGCAGGATCC AGAAATATGTTAGCTGGTATCAGCAGAAGCCAGGCCAGTCCCCTGTCCTGGTCATCTATCAAGATAATAAGTGGCCCTCAGGGATCC CTGAGCGATTCTCTGGCTCCAACTCTGGGAACACAGCCACTCTGACCATCAGCGGTATAATAGGAACTATAGGCTACTACTACGGTATGGACGTCTG GGGCCAAGGGACCACCGTCAGTCCAGGCGATCAGCCAGGATGTGGCGAGGATCTGGAGGTGCAGGAGGTGGAAGCTGCTCTATGAGC AGCTGGTATCAGCAGAAGCCAGGCCAGTCCCCTGTCCTCCCAGCCACTCTGACCATCAGCGGTATAATAAGTGGCCCTCAGGGATCC CTCTGGCTCCAACTCTGGGAACACAGCCACTCTGACCATCAGCGGACCCCAGGCTATGGATGAGGCTGACTATTACTGTCAGGCGT GGGACACCAGCACTGTGGTATTCGGCGGAGGGACCAAGCTGACCGTCCTA |
| 1200 | VL of CDH19 14304 | artificial | AA | SYELTQPPSVSVSPGQTASITCSGDRLGEKYVSWYQQKPGQSPILVIYQDNKWPSGIPERFSGSNSGNTATLTISGTQAMDEADYY CQAWDSSTVVFGGGTKLTVL |
| 1201 | VH-VL of CDH19 14304 | artificial | NT | CAGGTCAGTTGTGGAGTCTGGGGAGGCGTGGTCCAGCCTGGGGGGTCCCTGAGACTCTCCTGTGCAGCGTCTGGATTCACCTT CAGTAGCTATGGCATGCACTGGGTCCGCCAGGCTCCAGGCAAGGGGCTGGAGTGGGTGGCATTTATATGTATGATGAAGTAATA AATACTATGCAGACTCCGTGAAGGACCGATTCACCATCTCCAGAGACAATTCCAAGAACACGCTGTATCTGCAAATGAAAAGCCTG AGAGCTGAGGACACGGCTGTGTATTACTGTGCGAGAGGGCCGGTATAATAGGAACTATAGGCTACTACTACGGTATGGACGTCTG GGGCCAAGGGACCACGGTCACCGTCTCTAGTGGAGGTGGTGGAGGCGGAGGTGGCGGCGGATCTCTCCTATGAGC TGACTCAGCCACCCTCAGTTCCGTGTCCAGGACAGCCAGCCACGCCACCGTCAGATCTCTTGCAGGATCCAGAAATATGTT AGCTGGTATCAGCAGAAGCCAGGCCAGTCCCCTGTCCTGGTCATCTATCAAGATAATAAGTGGCCCTCAGGGATCCCTGAGCGATT CTCTGGCTCCAACTCTGGGAACACAGCCACTCTGACCATCAGCGGACCCCAGGCTATGGATGAGGCTGACTATTACTGTCAGGCGT GGGACAGCAGCACTGTGGTATTCGGCGGAGGGACCAAGCTGACCGTCCTA |
| 1202 | VH-VL of CDH19 14304 | artificial | AA | QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYV SWYQQKPGQSPILVIYQDNKWPSGIPERFSGSNSGNTATLTISGTQAMDEADYYCQAWDSSTVVFGGGTKLTVL |
| 1203 | CDH19 14304 × I2C | artificial | AA | QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYV SWYQQKPGQSPILVIYQDNKWPSGIPERFSGSNSGNTATLTISGTQAMDEADYYCQAWDSSTVVFGGGTKLTVLSGGGGSEVQLVE SGGGLVQPGGSLKLSCAASGFTNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |

TABLE VI-continued

| SEQ ID NO. | DESIGNATION | SOURCE | TYPE | SEQUENCE |
|---|---|---|---|---|
| 1204 | CDR-H1 of CDH19 14301 | artificial | AA | SYGMH |
| 1205 | CDR-H2 of CDH19 14301 | artificial | AA | FIWYDGSNKYYADSVKD |
| 1206 | CDR-H3 of CDH19 14301 | artificial | AA | RAGIIGYYYGMDV |
| 1207 | CDR-L1 of CDH19 14301 | artificial | AA | SGDRLGEKYTC |
| 1208 | CDR-L2 of CDH19 14301 | artificial | AA | QDTKRPS |
| 1209 | CDR-L3 of CDH19 14301 | artificial | AA | QAWESSTVV |
| 1210 | VH of CDH19 14301 | artificial | NT | CAGGTGCAGTTGGTGGAGTCTGGGGGAGGCGTGGTCCAGCCTGGAGGGTCCCTGAGACTCTCCTGTGCAGCGTCTGGATTCACCTT CAGTAGCTATGGCATGCACTGGGTCCGCCAGGCTCCAGGCAAGGGGCTGGAGTGGGTGGCATTTATATGATGGAAGTAATA AATACTATGCAGACTCCGTGAAGGACCGATTCACCATCTCCAGAGACAATTCCAAGAACACGCTGTATCTGCAAATGAACAGCCTG AGAGCTGAGGACACGGCTGTGTATTACTGTGCGAGAGGGGCCGGTATAATAGGCTACTACTACGGTATGGACGTCTG GGGCCAAGGGACCACGGTCACCGTCTCCTCAGT |
| 1211 | VH of CDH19 14301 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGYYYGMDVWGQGTTVTVSS |
| 1212 | VL of CDH19 14301 | artificial | NT | TCCTATGAACTTGACTCAGCCACCCTCAGTGTCTCCGGTCCCAGGACAGACAGCCAGCATCACCTGCTCTGGAGATAGGTTGGGGGA AAAATATAACTTGCTGGTATCAGCAGAAGCCAGGCCAGTCCCCTTTGCTGGTCATCTATCAAGATACCAAGCGGCCCTCAGGGATCC CTGAGCGATTCTCTGGCTCCAACTCTGGTAACACAGCACTGACTATCAGCGGGACCCAGGCTATGGATGAGGCTGACTATTAC TGTCAGGCGTGGGAGAGCAGCACTGTGGTATTCGGCGGAGGGACCAAGCTGACCGTCCTA |
| 1213 | VL of CDH19 14301 | artificial | AA | SYELTQPPSVSVSPGQTASITCSGDRLGEKYTCWYQQRPGQSPLLVIYQDTKRPSGIPERFSGSNSGNTATLTISGTQAMDEADYY CQAWESSTVVFGGGTKLTVL |
| 1214 | VH-VL of CDH19 14301 | artificial | NT | CAGGTGCAGTTGGTGGAGTCTGGGGGAGGCGTGGTCCAGCCTGGAGGGTCCCTGAGACTCTCCTGTGCAGCGTCTGGATTCACCTT CAGTAGCTATGGCATGCACTGGGTCCGCCAGGCTCCAGGCAAGGGGCTGGAGTGGGTGGCATTTATATGATGGAAGTAATA AATACTATGCAGACTCCGTGAAGGACCGATTCACCATCTCCAGAGACAATTCCAAGAACACGCTGTATCTGCAAATGAACAGCCTG AGAGCTGAGGACACGGCTGTGTATTACTGTGCGAGAGGGGCCGGTATAATAGGCTACTACTACGGTATGGACGTCTG GGGCCAAGGGACCACGGTCACCGTCTCCTCAGTGGTGGCGGAGGATCGGCGAGGTGGAAGCGAGGCGGGGATCTCTATGAAC TGACTCAGCCACCCTCAGTGTCTCCGGGACAGACAGCCAGCATCACCTGCTCTGGAGATAGGTTGGGGGATAGGAAAAATATACT TGCTGGTATCAGCAGAAGCCAGGCCAGTCCCCTTTGCTGGTCATCTATCAAGATACCAAGCGGCCCTCAGGGATCCCTGAGCGATT CTCTGGCTCCAACTCTGGTAACACAGCCACTCTGACTATCAGCGGGACCCAGGCTATGGATGAGGCTGACTATTACTGTCAGGCGT GGGAGAGCAGCACTGTGGTATTCGGCGGAGGGACCAAGCTGACCGTCCTA |
| 1215 | VH-VL of CDH19 14301 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGYYYGMDVWGQGTTVTVSSGGGGSGGGGSSYELTQPPSVSVSPGQTASITCSGDRLGEKYT CWYQQRPGQSPLLVIYQDTKRPSGIPERFSGSNSGNTATLTISGTQAMDEADYYCQAWESSTVVFGGGTKLTVL |
| 1216 | CDH19 14301 x I2C | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGYYYGMDVWGQGTTVTVSSGGGGSGGGGSGGGGSSYELTQPPSVSVSPGQTASITCSGDRLGEKYT |

TABLE VI-continued

| SEQ ID NO. | DESIGNATION | SOURCE | TYPE | SEQUENCE |
|---|---|---|---|---|
| | | | | CWYQQRPGQSPLLVIYQDTKRPSGIPERFSGSNSGNTATLTISGTQAMDEADYYCQAWESSTVVFGGGTKLTVLSGGGGSEVQLVE |
| | | | | SGGGLVQPGGSLKLSCAASGFTFNKYAMNWVRQAPGKGLEWVARIRSKYNNYATYYADSVKDRFTISRDDSKNTAYLQMNNLKTED |
| | | | | TAVYYCVRHGNFGNSYISYWAYWGQGTLVTVSSGGGGSGGGGSGGGGSQTVVTQEPSLTVSPGGTVTLTCGSSTGAVTSGNYPNWV |
| | | | | QQKPGQAPRGLIGGTKFLAPGTPARFSGSLLGGKAALTLSGVQPEDEAEYYCVLWYSNRWVFGGGTKLTVLHHHHHH |
| 1217 | CDR-H1 of CDH19 14079 | artificial | AA | RYGIH |
| 1218 | CDR-H2 of CDH19 14079 | artificial | AA | VIWYEGSNKYYAESVKG |
| 1219 | CDR-H3 of CDH19 14079 | artificial | AA | RAGIPGTTGYYYGMDV |
| 1220 | CDR-L1 of CDH19 14079 | artificial | AA | SGDRLGEKYVS |
| 1221 | CDR-L2 of CDH19 14079 | artificial | AA | QDNKWPS |
| 1222 | CDR-L3 of CDH19 14079 | artificial | AA | QAWESSTVV |
| 1223 | VH of CDH19 14079 | artificial | NT | CAGGTGCAGCTGGTGGAGTCTGGGGGAGGCGTGGTCCAGCCTGGGGGGTCCCTGAGACTCTCCTGTGCAGCTCTGGATTCACCTT CAGTCGCTATGCAGTGCATACATGCAGTGGGTCCGCCAGGCTCCAGGCAAGGGGCTGGAGTGGGTGGCAGTTATATGGTATGAGGGAAGTAATA AATACTATGCAGAGTCCGTGAAGGGCCGATTCACCATCTCCAGAGACAATTCCAAGAACACGCTGTATCTGCAAATGAACAGCCTG AGAGCCGAGGACTCGGCTGTCTATTACTGTGCGAGAGGGCCGGTATACCTGGAACTACGGGCTACTACTATGGTATGGACGTCTG GGGCCAAGGGACCACGGTCACCGTCTCCTCA |
| 1224 | VH of CDH19 14079 | artificial | AA | QVQLVESGGGVVQPGGSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSS |
| 1225 | VL of CDH19 14079 | artificial | NT | TCCTATGAGCTGACTCAGCCACCCTCAGTGTCCGTGTCCCCAGGACAGACAGCCAGCATCACCTGCTCTGGAGATAGATTGGGGGA GAAATATGTTAGCTGGTATCAGCAGAAGCCAGGCCAGTCCCCTATTCTGGTCATCTATCAGGATAATAAGTGGCCCTCAGGGATCC CTGAGCGATTCTCTGGCTCCAACTCTGGGAACACAGCCACTCTGACCATCAGCGGGACCCAGGCTATGGATGAGGCTGACTATTAC TGTCAGGCGTGGGAGAGCAGCACTGTGGTATTCGGCGGAGGGACCAAGCTGACCGTCCTA |
| 1226 | VL of CDH19 14079 | artificial | AA | SYELTQPPSVSVSPGQTASITCSGDRLGEKYVSWYQQKPGQSPILLVIYQDNKWPSGIPERFSGSGSNTATLTISGTQAMDEADYY CQAWESSTVVFGGGTKLTVL |
| 1227 | VH-VL of CDH19 14079 | artificial | NT | CAGGTGCAGCTGGTGGAGTCTGGGGGAGGCGTGGTCCAGCCTGGGGGGTCCCTGAGACTCTCCTGTGCAGCTCTGGATTCACCTT CAGTCGCTATGCAGATCACATGCAGTGGGTCCGCCAGGCTCCAGGCAAGGGGCTGGAGTGGCAGTTATATGGTATGAGGGAAGTAATA AATACTATGCAGAGTCCGTGAAGGGCCGATTCACCATCTCCAGAGACAATTCCAAGAACACGCTGTATCTGCAAATGAACAGCCTG AGAGCCGAGGACTCGGCTGTCTATTACTGTGCGAGAGGGCCGGTATACCTGGAACTACGGGCTACTACTATGGTATGGACGTCTG TGACTGGCCAAGGGACCACGGTCACCGTCTCCTCAGGTGCAGGTGCGGAGGTGGAAGCAGCAGCATCACCTGCTCTGGAGATAGATTGGGGGAGAAATATGTT AGCTGGTATCAGCAGAAGCCAGGCCAGTCCCCTATCTGGTCATCTATCAGGACCATCAGCGGGACCCAGGCTATGGATGAGGCTGACTATTAC TGTCAGGCTGGGAGAGCAGCACTGTGGTATTCGGCGGAGGGACCAAGCTGACCGTCCTA |

TABLE VI-continued

| SEQ ID NO. | DESIGNATION | SOURCE | TYPE | SEQUENCE |
|---|---|---|---|---|
| 1228 | VH-VL of CDH19 14079 | artificial | AA | QVQLVESGGGVVQPGGSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSSGGGGSGGGGSGGGGSYELTQPPSVSVSPGQTASITCSGDRLGEKYV SWYQQKPGQSPILVIYQDNKWPSGIPERFSGSSNSGNTATLTISGTQAMDEADYYCQAWESSTVVFGGGTKLTVL |
| 1229 | CDH19 14079 x I2C | artificial | | QVQLVESGGGVVQPGGSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSSGGGGSGGGGSGGGGSYELTQPPSVSVSPGQTASITCSGDRLGEKYV SWYQQKPGQSPILVIYQDNKWPSGIPERFSGSSNSGNTATLTISGTQAMDEADYYCQAWESSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1230 | CDR-H1 of CDH19 14077 | artificial | AA | RYGIH |
| 1231 | CDR-H2 of CDH19 14077 | artificial | AA | VIWYDGSNKYYADSVKG |
| 1232 | CDR-H3 of CDH19 14077 | artificial | AA | RAGIPGTTGYYYGMDV |
| 1233 | CDR-L1 of CDH19 14077 | artificial | AA | SGDRLGEKYVS |
| 1234 | CDR-L2 of CDH19 14077 | artificial | AA | QDNKWPS |
| 1235 | CDR-L3 of CDH19 14077 | artificial | AA | QAWDSSTVV |
| 1236 | VH of CDH19 14077 | artificial | NT | CAGGTGCAGCTGGTGGAGTCTGGGGGAGGCGTGGTCCAGCCTGGGGGGTCCCGCCAGCTCAGGCGAAGGGCTGGAGTGGGTGGCAGTTATATGGTATGATGGAAGTAATA AATACTATGCAGATCCAGATTCCCGTGAAGGGCCGATTCACCATCTCCAGAGACAATTCCAAGAACACGCTGTATCTGCAAATGAACAGCCTG AGAGCCGAGGACTCGGCTGTGTATTACTGTGCGAGAAGGGCCGGTATACCTGGAACTACGGGCTACTACTATGGTATGGACGTCTG GGGCCAAGGGACCACGGTCACCGTCTCCTCA |
| 1237 | VH of CDH19 14077 | artificial | AA | QVQLVESGGGVVQPGRSLRLSCAASGFTFSRYGIHWVRQAPGKGLEWVAVIWYDGSNKYYADSVKGRFTISRDNSKNTLYLQMNSL RAEDSAVYYCARRAGIPGTTGYYYGMDVWGQGTTVTVSS |
| 1238 | VL of CDH19 14077 | artificial | NT | TCCTATGAGCTGACTCAGCCACCCTCAGTGTCCGTGTCCCCAGGACAGAGCATCCAGCCTGCTCTGAGATAGATTGGGGA GAAATATGTTAGCTGGTATCAGCAGAAGCCAGGCCAGTCCCCTATACTGGTCATCTATCAAGATAATAAGTTGGCCTCAGGGATCC CTGAGCGATTCTCTGGCTCCAACTCAGGGAACACAGCCACTCTGACCATCACGGGACCCAGGCTATGGATGAGGCTGACTATTAC TGTCAGGCGTGGGACAGCAGCACTGTGGTATTCGGCGGAGGGACCAAGCTGACCGTCCTA |
| 1239 | VL of CDH19 14077 | artificial | AA | SYELTQPPSVSVSPGQTASITCSGDRLGEKYVSWYQQKPGQSPILVIYQDNKWPSGIPERFSGSNSGNTATLTISGTQAMDEADYY CQAWDSSTVVFGGGTKLTVL |
| 1240 | VH-VL of CDH19 14077 | artificial | NT | CAGGTGCAGCTGGTGGAGTCTGGGGGAGGCGTGGTCCAGCCTGGGGGGTCCCGCCAGCTCAGGCGAAGGGCTGGAGTGGGTGGCAGTTATATGGTATGATGGAAGTAATA AATACTATGCAGATCCAGATTCCCGTGAAGGGCCGATTCACCATCTCCAGAGACAATTCCAAGAACACGCTGTATCTGCAAATGAACAGCCTG AGAGCCGAGGACTCGGCTGTGTATTACTGTGCGAGAAGGGCCGGTATACCTGGAACTACGGGCTACTACTATGGTATGGACGTCTG |

TABLE VI-continued

| SEQ ID NO. | DESIGNATION | SOURCE | TYPE | SEQUENCE |
|---|---|---|---|---|
| | | | | GGGCCAAGGACCACCGTCACCGTCTCCTCAGGTGCGGAGGATCTGGCGGAGGTGGAAGCGGAGGCGGCGATCTTCCTATGAGC TGACTCAGCCACCCTCAGTGTCCGTCTCCGAGGACAGAGCAGCCAGCACCTGGTCATTATCAAGATATAAGTGCCCTCAGGATCCTGAGCGATT AGCTGGATCAGCAGAAGCCAGGCCAGTCCCTATCAGTCCCATCTGACCATCAGCGGACCATCAGCTATGATGAGGCTGACTATTACTGTCAGGCGT CTCTGGCTCCAACTCTGGAACACAGCCACTCTGACCATCAGCGGACCCAGCTATGATGAGGCTGACTATTACTGTCAGGCGT GGGACAGCAGCACTGTGTATTCGGCGGGAGGGACCAAGCTGACCGTCCTA |
| 1241 | VH-VL of CDH19 14077 | artificial | AA | QVQLVESGGGVVQPGRSLRLSCAASGFTFSRYGIHWVRQAPGKGLEWVAVIWYDGSNKYADSVKGRFTISRDNSKNTLYLQMNSL RAEDSAVYYCARRAGIPGTTGYYYGMDVWGQGTTVTVSSGGGGSGGGGSGGGGSSYELTQPPSVSVSPGQTASITCSGDRLGEKYV SWYQKPGQSPILVIYQDNKRPSGIPERFSGSNSGNTATLTISGTQAMDEADYYCQAWDSTVVFGGGTKLTVL |
| 1242 | CDH19 14077 x I2C | artificial | | QVQLVESGGGVVQPGRSLRLSCAASGFTFSRYGIHWVRQAPGKGLEWVAVIWYDGSNKYADSVKGRFTISRDNSKNTLYLQMNSL RAEDSAVYYCARRAGIPGTTGYYYGMDVWGQGTTVTVSSGGGGSGGGGSGGGGSSYELTQPPSVSVSPGQTASITCSGDRLGEKYV SWYQKPGQSPILVIYQDNKRPSGIPERFSGSNSGNTATLTISGTQAMDEADYYCQAWDSTVVFGGGTKLTVLSGGGGSEVQLVE SGGGLVQPGGSLKLSCAASGFTFNKYAMMWVRQAPGKGLEWVARIRSKYNNYATYYADSVKDRFTISRDDSKNTAYLQMNNLKTED TAVYYCVRHGNFGNSYISYNAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1243 | CDR-H1 of CDH19 14096 | artificial | AA | SYYIH |
| 1244 | CDR-H2 of CDH19 14096 | artificial | AA | IINPSGGSTRYAQKFQG |
| 1245 | CDR-H3 of CDH19 14096 | artificial | AA | GGIQLMLHFDY |
| 1246 | CDR-L1 of CDH19 14096 | artificial | AA | SGSSSNIGRNFVN |
| 1247 | CDR-L2 of CDH19 14096 | artificial | AA | TNNQRPS |
| 1248 | CDR-L3 of CDH19 14096 | artificial | AA | AAWDESLNGWV |
| 1249 | VH of CDH19 14096 | artificial | NT | CAGGTGCAGCTGGTGCAGTCTGGGGCTGAGGTGAAGAAGCCTGGGGCCTCAGTGAAGGTTTCCTGCAAGGCATCTGGATACACCTT CACCAGCTACTATATATTCACTGGGTGCGCCAGGCCCCTGGACAAGGACTTGAGTGGATGGGAATAATCAACCCCAGTGGTGGTAGCA CAAGGTACGCACAGAAGTTCCAGGGCAGAGTCACCATGACCAGGGACACGTCCACGAGCACAGTCTACATGGAGCTGAGCAGCCTG AGATCTGAGGACACGGCCGTGTATTACTGTGCGCGAGGGGGAATACAGCTGATGTTACATTTTGACTACTGGGGCCAGGGAACCCT GGTCACCGTCTCCTCA |
| 1250 | VH of CDH19 14096 | artificial | AA | QVQLVQSGAEVKKPGASVKVSCKASGYTFTSYYIHWVRQAPGQGLEWMGIINPSGGSTRYAQKFQGRVTMTRDTSTSTVMELSSL RSEDTAVYYCARGGIQLMLHFDYWGQGTLVTVSS |
| 1251 | VL of CDH19 14096 | artificial | NT | CAGTCTGCGCTGACTCAGCCACCCTCAGCGCTGGGACCCCGGGCAGAGGTCACCATCTCTTGTTCTGGAAGCAGCTCCAACAT CGGAAGGAATTTTGTAAACTGGTATCAGCAGCTCCCAGGAACGGCCCCCAAAGTCCATTATACTAATAATCAGCGGCCCTCAG GGGTCCCTGACCGATTCTCTGGCTCCAAGTCTGGCACCTCAGCTCTCCAGTCTGGGGCATCAGTCAGCTGAGGATGAGGCTGAT TATTACTGTGCAGCATGGGATGAGAGCCTGAATGGTTGGGTGTTCGGCGGAGGGACCAAGCTGACCGTCCTA |
| 1252 | VL of CDH19 14096 | artificial | AA | QSALTQPPSATGTPGQRVTISCSGSSSNIGRNFVNWYQQLPGTAPKVLIYTNNQRPSGVPDRFSGSKSGTSASLAISGLQSEDEAD YYCAAWDESLNGWVFGGGTKLTVL |

TABLE VI-continued

| SEQ ID NO. | DESIGNATION | SOURCE | TYPE | SEQUENCE |
|---|---|---|---|---|
| 1253 | VH-VL of CDH19 14096 | artificial | NT | CAGGTCAGTGCAGTCTGGGCTGAGTGAAGAAGCCTGGGGCCTCAGTGAAGGTTTCCTGCAAGGCATCTGGATACACCTT CACCAGTTACTATATGTCATGGGTGCGCCAGGCTCCTGGACAAGGACTTGAGTGATGGAATAATCAACCCAGTGGTAGCA CAAGGTACGCCACAGAAGTTCCAGGGCAGAGTCACCATGACCAGGGACACGTCCACGAGCACAGTCTACATGGAGCTGAGCAGCCTG AGATCTGAGGACACGGCCGTGTATTACTGTGCGAGAGGGATTATCACTGGTTACACTTTGACTACTGCCACCCT GGTCACCGTCTCCTCAGGTGGCGGCAGAGGATCTGGCGGAGGTGAAGCGGGACAGCTCCAACATCGGAAGAATTTGTAAAACTGGTAT CAGCAGCTCCCAGGACCCCGGACAGCGCCCCTCCTGCCCATCAGTGGGTCCCAAGTCCTCATTTATACTAATAATCAGCGCCCCTCAGGGGTCCCTGACCGATTCTCTGGCTC CAAGTCTGGCACCTCAGCCTCTCCTGCCCTGGGCCATCAGTGGCTCCAGTCTGAGGATGAGGCTGATTATTACTGTGCAGCAGATGAGA GCCTGAATGGTTGGGTGTTCGGCGGAGGGACCAAGCTGACCGTCCTA |
| 1254 | VH-VL of CDH19 14096 | artificial | AA | QVQLVQSGAEVKKPGASVKVSCKASGYTFTSYYIHWVRQAPGQGLEWMGIINPSGGSTRYAQKFQGRVTMTRDTSTSTVMELSSL RSEDTAVYYCARGGIQLWLHFDYWGQGTLVTVSSGGGGSGGGGSGGGGSQSALTQPPSATGTPGQRVTISCSGSSSNIGRNFVNWY QQLPGTAPKVLIYTNNQRPSGVPDRFSGSKSGTSASLAISGLQSEDEADYYCAAWDESLNGWVFGGGTKLTVL |
| 1255 | CDH19 14096 x I2C | artificial | AA | QVQLVQSGAEVKKPGASVKVSCKASGYTFTSYYIHWVRQAPGQGLEWMGIINPSGGSTRYAQKFQGRVTMTRDTSTSTVMELSSL RSEDTAVYYCARGGIQLWLHFDYWGQGTLVTVSSGGGGSGGGGSGGGGSQSALTQPPSATGTPGQRVTISCSGSSSNIGRNFVNWY QQLPGTAPKVLIYTNNQRPSGVPDRFSGSKSGTSASLAISGLQSEDEADYYCAAWDESLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1256 | CDR-H1 of CDH19 14088 | artificial | AA | SYYMS |
| 1257 | CDR-H2 of CDH19 14088 | artificial | AA | IIHPSGDTTYAQKFQG |
| 1258 | CDR-H3 of CDH19 14088 | artificial | AA | GGIKLWLHFDY |
| 1259 | CDR-L1 of CDH19 14088 | artificial | AA | SGSRSNIGSNFVN |
| 1260 | CDR-L2 of CDH19 14088 | artificial | AA | TNNQRPS |
| 1261 | CDR-L3 of CDH19 14088 | artificial | AA | AVWDDSLNGWV |
| 1262 | VH of CDH19 14088 | artificial | NT | CAGGTGCAGTTGGTGCAGTCTGGGCTGAGGTGAAGAAGCCTGGGGCCTCAGTGAAGGTTTCCTGTAAGGCATCTGGATACACCTT CACCAGTTACTACATGTCTTGGGTGCGACAGGCTCCTGGACAAGGGCTTGAGTGGATGGGAATAATCCACCCTAGTGGTGACA CAACCTACGCACAGAAGTTCCAGGGCAGAGTCACCATGACCAGGGACACGTCCACGAGCACAGTCTACATGGAGCTGAGCAGCCTG AGATCTGAGGACACGGCCGTGTATTACTGTGCGAGAGGGGGATAAAACTATGGTTACATTTGACTATTGGGGCCAGGGAACCCT GGTCACCGTCTCCTCA |
| 1263 | VH of CDH19 14088 | artificial | AA | QVQLVQSGAEVKKPGASVKVSCKASGYTFTSYYMSWVRQAPGQGLEWMGIIHPSGDTTYAQKFQGRVTMTRDTSTSTVMELSSL RSEDTAVYYCARGGIKLWLHFDYWGQGTLVTVSS |
| 1264 | VL of CDH19 14088 | artificial | NT | CAGTCTGTTGCTGACTCAGCCACCCTCAGCGTCTGGGACCCCCGGACAGAGGGTCACCATCTCTTGTTCTGGAAGCCGCTCCAACAT CGGAAGTAATTTTGTAAACTGGTACCAGCAGCTCCCAGGAACGGCCCCCAAACTCCTCATCTATACTAATAATCAGCGGCCCTCAG |

TABLE VI-continued

| SEQ ID NO. | DESIGNATION | SOURCE | TYPE | SEQUENCE |
|---|---|---|---|---|
| | | | | GGGTCCCTGACCGATTCTCTGGCTCCAAGTCTGGACACTCAGCTCCCTGGCCATCAGTGGCTCCAGTCTGAGGATGAGGCTGAT |
| | | | | TATTACTGTCAGTATGGGATGACAGCCTGAATGGTTGGTTCGGCGGAGGGACCAAGCTGACCGTCCTA |
| 1265 | VL of CDH19 14088 | artificial | AA | QSVLTQPPSASGTPGQRVTISCSGSRSNIGSNFVNWYQQLPGTAPKLLIYTNNQRPSGVPDRFSGSKSGTSASLAISGLQSEDEAD |
| | | | | YYCAVWDDSLNGWVFGGGTKLTVL |
| 1266 | VH-VL of CDH19 14088 | artificial | NT | CAGGTCCAGTTGGTGCAGTCTGGGGCTGAGGTGAAGAAGCCTGGGGCCTCAGTGAAGGTTTCCTGTAAGGCATCTGGATACACCTT |
| | | | | CACCAGCTACTACTATATGTCCTGGGTGCGACAGGCCCCTGGACAAGGGCTTGAGTGGATGGGAATAATCCACCCTAGTGGTGACA |
| | | | | CAACCTACGCACAGAAGTTCCAGGGCAGAGTCACCATGACCAGGGACACGTCCACGAGCACAGTCTACATGGAGCTGAGCAGCCTG |
| | | | | AGATCTGAGGACACGGCCGTGTATTACTGTGCGAGAGGGGGGATAAAACTATGGTTACATTTTGACTATTGGGGCCAGGGAACCCT |
| | | | | GGTCACCGTCTCCTCAGGTGGAGGTGGCAGCGGCGGTGGCGGGTCGGGTGGAGGTGGAAGCGGCGGTGGCGGATCTCAGTCTGTGCTGACTCAGCCACCCT |
| | | | | CAGCAGTCCCCAGAACGCCCCCAACTCTCATCTATACAATCAGGCGCCCTCAGGGGTCCCTGACCGATTCTCTGGCTC |
| | | | | CAAGTCTGGCACCTCAGCCTCTGCCTCCATCAGTGGGCTCCAGTCTGAGGATGAGGCTGATTATTACTGTCAGTATGGGATGACA |
| | | | | GCCTGAATGGTTGGTTCGGCGGAGGGACCAAGCTGACCGTCCTA |
| 1267 | VH-VL of CDH19 14088 | artificial | AA | QVQLVQSGAEVKKPGASVKVSCKASGYTFTSYYMSWVRQAPGQGLEWMGIIHPSGDTTYAQKFQGRVTMTRDTSTSTVMELSSL |
| | | | | RSEDTAVYYCARGGIKLWLHFDYWGQGTLVTVSSGGGGSGGGGSGGGGSQSVLTQPPSASGTPGQRVTISCSGSRSNIGSNFVNWY |
| | | | | QQLPGTAPKLLIYTNNQRPSGVPDRFSGSKSGTSASLAISGLQSEDEADYYCAVWDDSLNGWVFGGGTKLTVL |
| 1268 | CDH19 14088 x I2C | artificial | | QVQLVQSGAEVKKPGASVKVSCKASGYTFTSYYMSWVRQAPGQGLEWMGIIHPSGDTTYAQKFQGRVTMTRDTSTSTVMELSSL |
| | | | | RSEDTAVYYCARGGIKLWLHFDYWGQGTLVTVSSGGGGSGGGGSGGGGSQSVLTQPPSASGTPGQRVTISCSGSRSNIGSNFVNWY |
| | | | | QQLPGTAPKLLIYTNNQRPSGVPDRFSGSKSGTSASLAISGLQSEDEADYYCAVWDDSLNGWVFGGGTKLTVLSGGGGSEVQLVES |
| | | | | GGGLVQPGGSLKLSCAASGFTFNKYAMNWVRQAPGKGLEWVARIRSKYNNYATYYADSVKDRFTISRDDSKNTAYLQMNNLKTEDT |
| | | | | AVYYCVRHGNFGNSYISYWAYWGQGTLVTVSSGGGGSGGGGSQTVVTQEPSLTVSPGGTVTLTCGSSTGAVTSGNYPNWVQ |
| | | | | QKPGQAPRGLIGGTKFLAPGTPARFSGSLLGGKAALTSGVQPEDEAEYYCVLWYSNRWVFGGGTKLTVLHHHHHH |
| 1269 | CDR-H1 of CDH19 14085 | artificial | AA | SYYMS |
| 1270 | CDR-H2 of CDH19 14085 | artificial | AA | IIHPSGGDTTYAQKFQG |
| 1271 | CDR-H3 of CDH19 14085 | artificial | AA | GGIKLWLHFDY |
| 1272 | CDR-L1 of CDH19 14085 | artificial | AA | SGSRSNIGSNFVN |
| 1273 | CDR-L2 of CDH19 14085 | artificial | AA | TNNQRPS |
| 1274 | CDR-L3 of CDH19 14085 | artificial | AA | AVYDDSLNGWV |
| 1275 | VH of CDH19 14085 | artificial | NT | CAGGTCCAGTTGGTGCAGTCTGGGGCTGAGGTGAAGAAGCCTGGGGCCTCAGTGAAGGTTTCCTGTAAGGCATCTAGATACACCTT |
| | | | | CACCAGTTACTACATGTCCTGGGTGCGACAGGCCCCTGGACAAGGGCTTGAGTGGATGGGAATAATCCACCCTAGTGGTGTGACA |
| | | | | CAACCTACGCACAGAAGTTCCAGGGCAGAGTCACCATGACCCGGGACACGTCCACGAGCACAGTCTACATGGAGCTGAGCAGCCTG |
| | | | | AGATCTGAGGACACGGCCGTGTATTACTGTGCGAGAGGGGGGATAAACTATGGTTACATTTTGACTATTGGGGCCAGGGAACCCT |
| | | | | GGTCACCGTCTCCTCA |

TABLE VI-continued

| SEQ ID NO. | DESIGNATION | SOURCE | TYPE | SEQUENCE |
|---|---|---|---|---|
| 1276 | VH of CDH19 14085 | artificial | AA | QVQLVQSGAEVKKPGASVKVSCKASRYTFTSYYMSWVRQAPGQGLEWMGIIHPSGGDTTYAQKFQGRVTMTGDTSTSTVYMELSSL RSEDTAVYYCARGGIKLWLHFDYWGQGTLVTVSS |
| 1277 | VL of CDH19 14085 | artificial | NT | CAGTCTGTGCTGACTCAGCCACCCTCAGCGTCTGGGACCCCTGGGACAGAGGGTCACCATCTCTTGTTCTGGAAGCCGCTCCAACAT CGGAAGTAATTTTGTAAACTGGTACCAGCAGCTCCCAGGAACGGCCCCCAAACTCCTCATCTATACTAATAATCAGCGGCCCTCAG GGGTCCCTGACCGATTCTCTGGCTCCAAGTCTGGCACCTCAGCCCTGGCCATCAGTGGGGCTCCAGTCTGAGGATGAGGCTGAT TATTACTGTGCAGTATACGATGACAGCCTGAATGGTTGGGTGTTCGGCGGAGGGACCAAGCTGACCGTCCTA |
| 1278 | VL of CDH19 14085 | artificial | AA | QSVLTQPPSASGTPGQRVTISCSGSRSNIGSNFVNWYQQLPGTAPKLLIYTNNQRPSGVPDRFSGSKSGTSASLAISGLQSEDEAD YYCAVYDDSLNGWVFGGGTKLTVL |
| 1279 | VH-VL of CDH19 14085 | artificial | NT | CAGGTCAGTTGGTGCAGTCTGGGGCTGAGGTGAAGAAGCCTGGGGCCTCAGTGAAGGTTTCCTGTAAGGCATCTAGATACACCTT CACCAGCTACTATATGTCTGGGTGCGACAGGCCCCTGGACAAGGGCTTGAGTGGATGGGAATAATCCACCCTAGTGGTGATGACA CAACCTACGCACAGAAGTTCCAGGGCAGAGTCACCATGACCGGGACACAGTCTACCAGCACATGGAGCTGAGCAGCCTG AGATCTGAGGACTCCGCTGTGTATTACTGTGCGAGAGGGGGGATAAAACTGGTTACATTTTGACTATTGGGGCCAGGGAACCCT GGTCACCGTCTCCTCAGGTGGCGGAGGATCTGGCGGAGGTGGGAGCGGCGGAGGATCTCAGTCTGTGCTGACTCAGCCACCT CAGCGTCTGGGACCCCGGACAGAGGGTCACCATCTGTTCTGGAAGCCGCTCCAACATCGGAAGTAATTTTGTAAACTGGTAC CAGCAGCTCCCAGGAACGGCCCCCAAACTCCTCATCTATACTAATAATCAGCGGCCCTCAGGGGTCCCTGACCGATTCTCTGGCTC CAAGTCTGGCACCTCAGCCCTGGCCATCAGTGGGCTCCAGTCTGAGGATGAGGCTGATTATTACTGTGCAGTATACGATGACA GCCTGAATGGTTGGGTGTTCGGCGGAGGGACCAAGCTGACCGTCCTA |
| 1280 | VH-VL of CDH19 14085 | artificial | AA | QVQLVQSGAEVKKPGASVKVSCKASRYTFTSYYMSWVRQAPGQGLEWMGIIHPSGGDTTYAQKFQGRVTMTGDTSTSTVYMELSSL RSEDTAVYYCARGGIKLWLHFDYWGQGTLVTVSSGGGGSGGGGSGGGGSQSVLTQPPSASGTPGQRVTISCSGSRSNIGSNFVNWY QQLPGTAPKLLIYTNNQRPSGVPDRFSGSKSGTSASLAISGLQSEDEADYYCAVYDDSLNGWVFGGGTKLTVL |
| 1281 | CDH19 14085 x I2C | artificial | AA | QVQLVQSGAEVKKPGASVKVSCKASRYTFTSYYMSWVRQAPGQGLEWMGIIHPSGGDTTYAQKFQGRVTMTGDTSTSTVYMELSSL RSEDTAVYYCARGGIKLWLHFDYWGQGTLVTVSSGGGGSGGGGSGGGGSQSVLTQPPSASGTPGQRVTISCSGSRSNIGSNFVNWY QQLPGTAPKLLIYTNNQRPSGVPDRFSGSKSGTSASLAISGLQSEDEADYYCAVYDDSLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSPGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1282 | CDR-H1 of CDH19 14074 | artificial | AA | SYFIH |
| 1283 | CDR-H2 of CDH19 14074 | artificial | AA | IINPISVSTSYAQKFQG |
| 1284 | CDR-H3 of CDH19 14074 | artificial | AA | GGIQLWLHLDY |
| 1285 | CDR-L1 of CDH19 14074 | artificial | AA | SGSRSNIGSNFVN |
| 1286 | CDR-L2 of CDH19 14074 | artificial | AA | TNNQRPS |
| 1287 | CDR-L3 of CDH19 14074 | artificial | AA | ATWDDSMNGWV |

TABLE VI-continued

| SEQ ID NO. | DESIGNATION | SOURCE | TYPE | SEQUENCE |
|---|---|---|---|---|
| 1288 | VH of CDH19 14074 | artificial | NT | CAGGTGCAGTTGGTGCAGTCTGGGGCTGAGGTGAAGAAGCCTGGGGCCTCAGTGAAGGTTTCCTGCAAGGTTTCTGGATACACCTT CACCAGCTACTTTATTCACTGGGTGCGCCAGGCCCCTGGACAAGGGCTTGAATGATGGGAATTATCAACCCTATTAGTGTTAGCA CAAGCTACGCCCAGAAGTTCCAGGGCAGAGTCACCATGACCAGGGACACGTCCACGAGCACAGTCTTCATGGAGCTGAGCAGCCTG AGATCTGAGGACACGGCCGTGTATTACTGCGCGAGGGGGATACAGCTATGGTTACATTTGGACTACTGGGGCCAGGGAACCCT GGTCACCGTCTCCTCA |
| 1289 | VH of CDH19 14074 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSS |
| 1290 | VL of CDH19 14074 | artificial | NT | CAGTCTGCGCTGACTCAGCCACCCTCAGTGACTGGGACCCAGAGAGTCACCATCTCTTGTTCTGGAAGCAGGTCCAACATCGGGAGT AATTTTGTAAACTGGTACCAGCAGCTCCCAGGAACGGCCCCCAAAGTCCTCATCTATACTAATAATCAGCGGCCCTCAG GGGTCCCTGACCGATTCTCTGGCTCCAAGTCTGGCACCTCAGCCTCCCTGGCCATCAGTGGGCTCCAGTCTGAGGATGAGGCTGAT TATTACTGCGCAACATGGATGACAGTATGAATGGTTGGGTGTTCGGCGGAGGGACCAAACTGACCGTCCTA |
| 1291 | VL of CDH19 14074 | artificial | AA | QSALTQPPSVTGTPGQRVTISCSGSRSNIGSNFVNWYQQLPGTAPKVLIYTNNQRPSGVPDRFSGSKSGTSASLAISGLQSEDEAD YYCATWDDSMNGWVFGGGTKLTVL |
| 1292 | VH-VL of CDH19 14074 | artificial | NT | CAGGTGCAGTTGGTGCAGTCTGGGGCTGAGGTGAAGAAGCCTGGGGCCTCAGTGAAGGTTTCCTGCAAGGTTTCTGGATACACCTT CACCAGCTACTTTATTCACTGGGTGCGCCAGGCCCCTGGACAAGGGCTTGAATGATGGGAATTATCAACCCTATTAGTGTTAGCA CAAGCTACGCCCAGAAGTTCCAGGGCAGAGTCACCATGACCAGGGACACGTCCACGAGCACAGTCTTCATGGAGCTGAGCAGCCTG AGATCTGAGGACACGGCCGTGTATTACTGCGCGAGGGGGATACAGCTATGGTTACATTTGGACTACTGGGGCCAGGGAACCCT GGTCACCGTCTCCTCAGGTGGAGGCGGTTCAGGCGGAGGTGGAAGCGGAGGTGGCGGATCTGAAGCGGGACAGGTCCAACATCGGGAAGCAGGTCCAACATCGGAAGCAGGTCCAACATCAGCGGCCCTCCCAGGGTCCCTGACCGATTCTCTGGCTCC AAGTCTGGCACCTCAGCCTCCCTGGCCATCAGTGGGCTCCAGTCTGAGGATGAGGCTGATTATTACTGCGCAACACTGGATGACA GTATGAATGGTTGGGTGTTCGGCGGAGGGACCAAACTGACCGTCCTA |
| 1293 | VH-VL of CDH19 14074 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDDSMNGWVFGGGTKLTVL |
| 1294 | CDH19 14074 × I2C | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDDSMNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1295 | CDR-H1 of CDH19 14075 | artificial | AA | SYFIH |
| 1296 | CDR-H2 of CDH19 14075 | artificial | AA | IINPISVSTSYAQKFQG |
| 1297 | CDR-H3 of CDH19 14075 | artificial | AA | GGIQLWLHLDY |
| 1298 | CDR-L1 of CDH19 14075 | artificial | AA | SGSRSNIGSNFVN |

TABLE VI-continued

| SEQ ID NO. | DESIGNATION | SOURCE | TYPE | SEQUENCE |
|---|---|---|---|---|
| 1299 | CDR-L2 of CDH19 14075 | artificial | AA | TNNQRPS |
| 1300 | CDR-L3 of CDH19 14075 | artificial | AA | ATWDESMQGWV |
| 1301 | VH of CDH19 14075 | artificial | nt | CAGGTGCAGTTGGTGCAGTCTGGGGCTGAGGTGAAGAAGCCTGGGGCCTCAGTGAAGGTTTCCTGCAAGGTTTCTGGATACACCTT CACCAGCTACTTTATTCACTGGGTGCGCCAGGCCCCTGGACAAGGGCTTGAGTGGATGGGAATTATCAACCCTATTAGTGTTAGCA CAAGCTACGCACAGAAGTTCCAGGGCAGAGTCACCATGACCAGGGACACGTCCACAAGTCCATCTATACTAATAATCAGCGCCCTG AGATCTGAGGACACGGCCGTGTATTACTGTGCGAGGGGGATACAGCTATGGTTACATTTGGACTACTGGGGCCAGGGAACCCT GGTCACCGTCTCCTCA |
| 1302 | VH of CDH19 14075 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSS |
| 1303 | VL of CDH19 14075 | artificial | nt | CAGTCTGCCCTGACTCAGCCTCGCTCAGTGACTGGGACTCCAGAGGTCACCATCTCTTGTTCTGAAGCAGGTCCAACAT CGGAAGCAATTTGTAAACTGGTACCAGCAGCTCCCAGGAACGGCCCCCAAAGTCCTCATCTATACTAATAATCAGCGGCCCTCAG GGGTCCCTGACCGATTCTCTGGCTCCAAGTCTGGCAACACAGCCTTCACTCTGACCATCAGTGGGCTCCAGTCTGAGGATGAGGCTGAT TATTACTGCGCAACATGGGATGAGAGTATGCAAGGTTGGGTGTTCGGCGGAGGGACCAAACTGACCGTCCTA |
| 1304 | VL of CDH19 14075 | artificial | AA | QSALTQPPSVTGTPGQRVTISCSGSRSNIGSNFVNWYQQLPGTAPKVLIYTNNQRPSGVPDRFSGSKSGTSASLAISGLQSEDEAD YYCATWDESMQGWVFGGGTKLTVL |
| 1305 | VH-VL of CDH19 14075 | artificial | nt | CAGGTGCAGTTGGTGCAGTCTGGGGCTGAGGTGAAGAAGCCTGGGGCCTCAGTGAAGGTTTCTGCAAGGTTTCTGGATACACCTT CACCAGCTACTTTATTCACTGGGTGCGCCAGGCCCCTGGACAAGGGCTTGAGTGGATGGGAATTATCAACCCTATTAGTGTTAGCA CAAGCTACGCACAGAAGTTCCAGGGCAGAGTCACCATGACCAGGGACACGTCCACAAGTCCATCTTCATGGAGCTGAGCAGCCTG AGATCTGAGGACACGGCCGTGTATTACTGTGCGAGGGGGATACAGCTATGGTTACATTTGGACTACTGGGGCCAGGGAACCCT GGTCACCGTCTCCTCAGGTGGAGGCGGTTCAGGCGGAGGTGGCTCTGGCGGTGGCGGATCGCAGTCTGCCCTGACTCAGCCTCC CTCAGTCACTGGACCCCAAAGTCCCAAAGTCCATCTCTGCTCCAAGTGTGGTCTCAGAGGTCTGGTACTTCTGGCT CAAGTCTGGCAACATCGGGCACCTCCAAAGTCCTCATCTATACTAATAATCAGCGGCCCTCAGGGGTCCCTGATTCTCTGGCT CAAGTCTGGCACACAGCCTCCCTGGCTCCAAGTCTGGCAACACAGCCTTCACTCTGACCATCAGTGGGCTCCAGTCTGAGGATGAGA GTATGCAAGGTTGGGTGTTCGGCGGAGGGACCAAACTGACCGTCCTA |
| 1306 | VH-VL of CDH19 14075 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDESMQGWVFGGGTKLTVL |
| 1307 | CDH19 14075 x I2C | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDESMQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSQTVVTQEPSLTVSPGGTVLTLCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1308 | CDR-H1 of CDH19 14024 | artificial | AA | SSGYY |
| 1309 | CDR-H2 of CDH19 14024 | artificial | AA | YIYYTGSAYYNPSLKS |

TABLE VI-continued

| SEQ ID NO. | DESIGNATION | SOURCE | TYPE | SEQUENCE |
|---|---|---|---|---|
| 1310 | CDR-H3 of CDH19 14024 | artificial | AA | DGSSGWYFQY |
| 1311 | CDR-L1 of CDH19 14024 | artificial | AA | RASRQISSSYLA |
| 1312 | CDR-L2 of CDH19 14024 | artificial | AA | GPSSRAT |
| 1313 | CDR-L3 of CDH19 14024 | artificial | AA | QQYGSSFT |
| 1314 | VH of CDH19 14024 | artificial | nt | CAGGTGCAGCTGCAGGAGTCGGGCCCAGGACTGGTGAAGCCTTCAGAGACCCTGTCCCTCACCTGCACTGTCTCTGGTGGCTCCAT CAGCAGTAGTGGTTACTACCCGTCCTCAAGAGTCTGGAGTGGATTGGGTATATCTATTACACTGGGA GCGCCTACTACAACCCGTCCCTCAAGAGTCAGTAGACACGTCTAAGAACCAGTTCTCCCTGAAGCTGAGCTCT GTGACTGCCGCGGACACGGCCGTGTATTACTGTGCGAGAGATGGAAGCAGTGGCTGGTACTTCCAGTATTGGGGCCAGGGCACCCT GGTCACCGTCTCTAGT |
| 1315 | VH of CDH19 14024 | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSS |
| 1316 | VL of CDH19 14024 | artificial | nt | GAAATTGTGTTGACGCAGTCTCCAGGCACCCTGTCTTTGTCTCCAGGGGAAAGAGCCACCCTCTCCTGCAGGGCCAGTCGGCAGAT TAGCAGCAGCTACTTAGCCTGGTACCAGCAGAAACCTGGCCAGGCTCCCAGGCTCCTCATCTATGGTCCATCCAGCAGGGCCACTG GCATCCCAGACAGGTTCAGTGGCAGTGGGTCTGGGACAGACTTCACTCTCACCATCAGCAGACTGGAGCCTGAAGATTTTGCAGTG TATTACTGTCAGCAGTATGGTAGCTCATTCACTTTCGGCCAGGGGACCAAAGTGGATATCAAA |
| 1317 | VL of CDH19 14024 | artificial | AA | EIVLTQSPGTLSLSPGERATLSCRASRQISSSYLAWYQQKPGQAPRLLIYGPSSRATGIPDRFSGSGSGTDFTLTISRLEPEDFAV YYCQQYGSSFTFGQGTKVDIK |
| 1318 | VH-VL of CDH19 | artificial | nt | CAGGTGCAGCTGCAGGAGTCGGGCCCAGGACTGGTGAAGCCTTCAGAGACCCTGTCCCTCACCTGCACTGTCTCTGGTGGCTCCAT CAGCAGTAGTGGTTACTACCCGTCCTCAAGAGTCTGGAGTGGATTGGGTATATCTATTACACTGGGA GCGCCTACTACAACCCGTCCCTCAAGAGTCAGTAGACACGTCTAAGAACCAGTTCTCCCTGAAGCTGAGCTCT GTGACTGCCGCGGACACGGCCGTGTATTACTGTGCGAGAGATGGAAGCAGTGGCTGGTACTTCCAGTATTGGGGCCAGGGCACCCT GGTCACCGTCTCTAGTGGTGGCGGAGGATCTGGCGGCGGAGGTCAGGGCCAGTCGACAGCTGGTCAGCAGTTCAGTGGCAG CACCAGAAACCTGGCCAGGCTCCCAGGCTCCTCATCTATGGTCCATCCAGCAGGGCCACTGGCATCCCAGACAGGTTCAGTGGTAC TGGGTCTGGGACAGACTTCACTCTCACCATCAGCAGACTGGAGCCTGAAGATTTTGCAGTGTATTACTGTCAGCAGTATGGTAGCT CATTCACTTTCGGCCAGGGGACCAAAGTGGATATCAAA |
| 1319 | VH-VL of CDH19 14024 | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSSGGGGSGGGGSGGGGSEIVLTQSPGTLSLSPGERATLSCRASRQISSSYLAWY QQKPGQAPRLLIYGPSSRATGIPDRFSGSGSGTDFTLTISRLEPEDFAVYYCQQYGSSFTFGQGTKVDIK |
| 1320 | CDH19 14024 x I2C | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSSGGGGSGGGGSGGGGSEIVLTQSPGTLSLSPGERATLSCRASRQISSSYLAWY QQKPGQAPRLLIYGPSSRATGIPDRFSGSGSGTDFTLTISRLEPEDFAVYYCQQYGSSFTFGQGTKVDIKSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQQGTLVTVSSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |

TABLE VI-continued

| SEQ ID NO. | DESIGNATION | SOURCE | TYPE | SEQUENCE |
|---|---|---|---|---|
| 1321 | CDR-H1 of CDH19 14054 | artificial | AA | SYDMH |
| 1322 | CDR-H2 of CDH19 14054 | artificial | AA | VISYDGTNEYYADSVKG |
| 1323 | CDR-H3 of CDH19 14054 | artificial | AA | ERYFDWSFDY |
| 1324 | CDR-L1 of CDH19 14054 | artificial | AA | RASQSVSNTYLA |
| 1325 | CDR-L2 of CDH19 14054 | artificial | AA | GASSRAT |
| 1326 | CDR-L3 of CDH19 14054 | artificial | AA | QQYSNSWT |
| 1327 | VH of CDH19 14054 | artificial | nt | CAGGTGCAGCTGGTGGAGTCTGGGGGAGGCGTGGTCCAGCCTGGGGGGTCCCTGAGACTCTCCTGTGCAGCCTCTGGATTCACCTT CAGTAGCTACGATATGCACTGGGTCCGCCAGGCTCCAGGCAAGGGGCTGGAGTGGGTGGCAGTTATATCATATGATGGAACTAATG AATACTATGCAGACTCCGTGAAGGGCCGATTCACCATCTCCAGAGACACTTCCAAGAACACGCTGTATTTGCAAATGAACAGCCTG AGAGCTGAGGACACGGCTGTATATTACTGTGCGAGAGAACGATATTTTGACTGGTCTTTTGACTACTGGGGCCAGGGAACCCTGGT CAGCGTCTCTAGT |
| 1328 | VH of CDH19 14054 | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSS |
| 1329 | VL of CDH19 14054 | artificial | nt | GAAATTGTATTGACGCAGTCTCCAGGCACCCTGTCTTTGTCTCCAGGGGAAAGAGCCACCCTCTCCTGCAGGGCCAGTCAGAGTGT TAGCAGCTACTTAGCGTGGTACCAGCAGAAACCTGGCCAGGCTCCCAGGCTCATCCAGGTGCATCCAGCAGGCCACTG GCATCCCAGACAGATTCAGTGGCAGTGGGTCTGGGACAGACTTCACTCTCACCATCAGCAGTCTGGAGCCTGAAGATTTTGCAGTG TATTACTGTCAGCAGTACAGTAACTCTGGACGTTCGGCCAAGGGACCAAGGTGGAAATCAAA |
| 1330 | VL of CDH19 14054 | artificial | AA | EIVLTQSPGTLSLSPGERATLSCRASQSVSNTYLAWYQQKPGQAPRLLIYGASSRATGIPDRFSGSGSGTDFTLTISSLEPEDFAV YYCQQYSNSWTFGQGTKVEIK |
| 1331 | VH-VL of CDH19 14054 | artificial | nt | CAGGTGCAGCTGGTGGAGTCTGGGGGAGGCGTGGTCCAGCCTGGGGGGTCCCTGAGACTCTCCTGTGCAGCCTCTGGATTCACCTT CAGTAGCTACGATATGCACTGGGTCCGCCAGGCTCCAGGCAAGGGGCTGGAGTGGGTGGCAGTTATATCATATGATGGAACTAATG AATACTATGCAGACTCCGTGAAGGGCCGATTCACCATCTCCAGAGACACTTCCAAGAACACGCTGTATTTGCAAATGAACAGCCTG AGAGCTGAGGACACGGCTGTATATTACTGTGCGAGAGAACGATATTTTGACTGGTCTTTTGACTACTGGGGCCAGGGAACCCTGGT CAGCGTCTCTAGTGGTGGCGGAGGATCTGAAGGTGGAGGCGGACAGTGTTAGCGAAGTGTCGAGTCGGAAGGTGGAGCAGTGTCCAGGCA CAGAGCCCTGGCCAGCCTCCTCATCTATGGTGCATCCAGCAGGGCCACTGGCATCCCAGACAGATTCAGTGGCAGTGG GTCTGGGACAGACTTCACTCTCACCATCAGCAGTCTGGAGCCTGAAGATTTTGCAGTGTATTACTGTCAGCAGTACAGTAACTCTGT GGACGTTCGGCCAAGGGACCAAGGTGGAAATCAAA |
| 1332 | VH-VL of CDH19 14054 | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QRPGQAPRLLIYGASSRATGIPDRFSGSGSGTDFTLTISSLEPEDFAVYYCQQYSNSWTFGQGTKVEIK |
| 1333 | CDH19 14054 x I2C | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ |

TABLE VI-continued

| SEQ ID NO. | DESIGNATION | SOURCE | TYPE | SEQUENCE |
|---|---|---|---|---|
| | | | | QRPGQAPRLLIYGASSRATGIPDRFSGSGSGTDFTLTISSLEPEDFAVYYCQQYSNSWTFGQGTKVEIKSGGGGSEVQLVESGGGL VQPGGSLKLSCAASGFTFNKYAMNWVRQAPGKGLEWVARIRSKYNNYATYADSVKDRFTISRDDSKNTAYLQMNNLKTEDTAVYY CVRHGNFGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 1334 | CDR-H1 of CDH19 14056 | artificial | AA | GYYWS |
| 1335 | CDR-H2 of CDH19 14056 | artificial | AA | YFSYSGSTNYNPSLKS |
| 1336 | CDR-H3 of CDH19 14056 | artificial | AA | NWAFHFDF |
| 1337 | CDR-L1 of CDH19 14056 | artificial | AA | TGSSSNIGTGTYAVH |
| 1338 | CDR-L2 of CDH19 14056 | artificial | AA | GNNNRPS |
| 1339 | CDR-L3 of CDH19 14056 | artificial | AA | QSYDSRLSGWV |
| 1340 | VH of CDH19 14056 | artificial | nt | CAGGTGCAGCTGCAGGAGAGTCGGGCCCAGGAGTCGTGAAGCCTTCGGAGACCCTGTCCCTCACCTGCACTGTCTCTGGTGGCTCCAT CAGTGGTTACTACTGGAGCTGGATCCGGCAGCCCCCAGGAAAGGGACTGGAGTGGTTGCATATTCCTTACAGTGGGAGCACCA ACTACAACCCCTCCCTCAAGAGTCGAGTCACCATCAGTAGACACGTCAAGAACCAGTTCTCCCTGAAGCTGAGCTCTGTGACC GCTGCCGACACGGCCGTGTATTACTGTGCGAGAAACTGGGCCTTCCACTTTGACTTCTGGGGCCAGGGAACCCTGGTCACCGTCTC TAGT |
| 1341 | VH of CDH19 14056 | artificial | AA | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHFDFWGQGTLVTVSS |
| 1342 | VL of CDH19 14056 | artificial | nt | CAGTCTGTGCTGACGCAGCCGCCCTCAGTGTCTGGGGCCCCAGGACAGAGGGTCACCATCTCCTGCACTGGGAGCAGCTCCAACAT CGGAGCAGGTTATGCTGTACACCGGATCCAGCAGCTCCCAGGAACAGCCCCCAAACTCCTCATCTATGGTAACAACAATCGGCCCT CAGGGGTTCCTGACCGATTCTCTGGCTCCAAGCTCTGGCACCTCAGCCTCTGGGTCCTCAGGCTGCAGGTCCTCAAGGGATGAGGCT GATTATTACTGCCAGTCCTATGACAGCAGGCTGAGTGGTTGGGTGTTCGGCGGAGGGACCAAGCTGACCGTCCTA |
| 1343 | VL of CDH19 14056 | artificial | AA | QSVLTQPPSVSGAPGQRVTISCTGSSSNIGTGYAVHWYQQLPGTAPKLLIYGNNNRPSGVPDRFSGSKSGTSASLAITGLQAEDEA DYYCQSYDSRLSGWVFGGGTKLTVL |
| 1344 | VH-VL of CDH19 14056 | artificial | nt | CAGGTGCAGCTGCAGGAGAGTCGGGCCCAGGAGTCGTGAAGCCTTCGGAGACCCTGTCCCTCACCTGCACTGTCTCTGGTGGCTCCAT CAGTGGTTACTACTGGAGCTGGATCCGGCAGCCCCCAGGAAAGGGACTGGAGTGGTTGCATATTCCTTACAGTGGGAGCACCA ACTACAACCCCTCCCTCAAGAGTCGAGTCACCATCAGTAGACACGTCAAGAACCAGTTCTCCCTGAAGCTGAGCTCTGTGACC GCTGCCGACACGGCCGTGTATTACTGTGCGAGAAACTGGGCCTTCCACTTTGACTTCTGGGGCCAGGGAACCCTGGTCACCGTCTC TAGTGGTGGCGGAGGATCTGGCGGAGGTGGAAGCGGAGGCGGCGGATCTGTGCTGACGCAGCCGCCCTCAGTGTCTGGGG CCCCAGGACAGAGGGTCACCATCTCCTGCACTGGGAGCAGCTTATGCTGTACACCGGGATCCAGCAGCTT CCAGGAACAGCCCCCAAACTCCTCATCTATGGTAACAACAATCGGCCCTCAGGGGTTCCTGACCGATTCTCTGGCTCCAAGTCTGG CACCTCAGCCTCTGGCCATCACTGGGCTCCAGGCTGATTATTACTGCCAGTCCTATGACAGCAGGCTGAGTGGCTGATGAGTG GTTGGGTGTTCGGCGGAGGGACCAAGCTGACCGTCCTA |

TABLE VI-continued

| SEQ ID NO. | DESIGNATION | SOURCE | TYPE | SEQUENCE |
|---|---|---|---|---|
| 1345 | VH-VL of CDH19 14056 | artificial | AA | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHFDFWGQGTLVTVSSGGGGSGGGGSGGGGSQSVLTQPPSVSGAPGQRVTISCTGSSNIGTGYAVHWYQQL PGTAPKLLIYGNNNRPSGVPDRFSGSKSGTSASLAITGLQAEDEADYYCQSYDSRLSGWVFGGGTKLTVL |
| 1346 | CDH19 14056 x I2C | artificial | | QVQLQESGPGLVKPSETLSLTCTVSGGSISGYYWSWIRQPPGKGLEWFAYFSYSGSTNYNPSLKSRVTLSVDTSKNQFSLKLSSVT AADTAVYYCARNWAFHFDFWGQGTLVTVSSGGGGSGGGGSGGGGSQSVLTQPPSVSGAPGQRVTISCTGSSNIGTGYAVHWYQQL PGTAPKLLIYGNNNRPSGVPDRFSGSKSGTSASLAITGLQAEDEADYYCQSYDSRLSGWVFGGGTKLTVLSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISYWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1347 | CDR-H1 of CDH19 14057 | artificial | AA | GYYWS |
| 1348 | CDR-H2 of CDH19 14057 | artificial | AA | YFSYSGSTNYNPSLKS |
| 1349 | CDR-H3 of CDH19 14057 | artificial | AA | NWAFHFDF |
| 1350 | CDR-L1 of CDH19 14057 | artificial | AA | TGSSSNIGTGYAVH |
| 1351 | CDR-L2 of CDH19 14057 | artificial | AA | GNNNRPS |
| 1352 | CDR-L3 of CDH19 14057 | artificial | AA | QSYDSRLSGWV |
| 1353 | VH of CDH19 14057 | artificial | nt | CAGGTGCAGCTGCAGGAGTCGGGCCCAGGACTGGTGAAGCCTTCGGAGACCCTGTCCCTCACCTGCACTGTCTCTGGTGGCTCCAT CAGTGGTTACTACTGGAGCTGGATCCGGCAGCCCCCAGGAAAGGGACTGGAGTGGATTGCTTACATTTCTTACAGTGGGAGCACCA ACTACAACCCCTCCCTCAAGAGTCGAGTCACCTTATCAGTAGACACGTCCAAGAACCAGTTCTCCCTGAAGCTGAGCTCTGTGACC GCTGCGGACACGGCCGTGTATTACTGTGCGAGGAACTGGGCCTTCCACTTTGACTTCTGGGGCCAGGGAACCCTGGTCACCGTCTC TAGT |
| 1354 | VH of CDH19 14057 | artificial | AA | QVQLQESGPGLVKPSETLSLTCTVSGGSISGYYWSWIRQPPGKGLEWIGYFSYSGSTNYNPSLKSRVTLSVDTSKNQFSLKLSSVT AADTAVYYCARNWAFHFDFWGQGTLVTVSS |
| 1355 | VL of CDH19 14057 | artificial | nt | CAGTCTGTGCTGACGCAGCCGCCCTCAGTGTCTGGGGCTCCAGGACAGAGGGTCACCATCTCCTGCACTGGGAGTAACAACATCGGCCT CAGGGGTTCCTGCCGATTCTGTACCAGCTGACTGGTACAGTGGGTACCAGCAGCTTCCAGGACAGCCCCCAGCCTCCCGATCACTACTGGT CAGGGGTTCCTGACCATTCTCCCGGCTCCTCAGAGTGAGTCACCTTATCAGTAGACACGTCCAAGAACCAGTTCTCCCTGAAGCTGAGCT CTGTGACC GATTATTACTGCCAGTCCTATGACAGCAGACTGAGTGGTTCGGCGGACGTGGTCGGAGGGACCAAGCTGACCGTCCTA |
| 1356 | VL of CDH19 14057 | artificial | AA | QSVLTQPPSVSGAPGQRVTISCTGSSNIGTGYAVHWYQQLPGTAPKLLIYGNNNRPSGVPDRFSGSKSGTSASLAITGLQAEDEA DYYCQSYDSRLSGWVFGGGTKLTVL |
| 1357 | VH-VL of CDH19 14057 | artificial | nt | CAGGTGCAGCTGCAGGAGTCGGGCCCAGGACTGGTGAAGCCTTCGGAGACCCTGTCCCTCACCTGCACTGTCTCTGGTGGCTCCAT CAGTGGTTACTACTGGAGCTGGATCCGGCAGCCCCCAGGAAAGGGACTGGAGTGGATTGCTTACATTTCTTACAGTGGGAGCACCA ACTACAACCCCTCCCTCAAGAGTCGAGTCACCTTATCAGTAGACACGTCCAAGAACCAGTTCTCCCTGAAGCTGAGCTCTGTGACC GCTGCGGACACGGCCGTGTATTACTGTGCGAGGAACTGGGCCTTCCACTTTGACTTCTGGGGCCAGGGAACCCTGGTCACCGTCTC |

TABLE VI-continued

| SEQ ID NO. | DESIGNATION | SOURCE | TYPE | SEQUENCE |
|---|---|---|---|---|
| | | | | TAGTGGTGGCGGAGGATCTCGGCGAGGTGAAGCGGAGGCGGCGGATCTCAGTCTGTCGACGCAGCCGCCCTCAGTGTCTGGGG CCCAGGACAGAGGCCCCAAATCTCCTCATCTGACTGTAACAACATCGGCCTCAGGGGTTCCTGACCGATTCTCTGGCTGCAGTCTGG CACCTCAGCCCTCCCTGGCCATCACTGGGCTCCAGCTGACAGGGCTCAGCTGAGGATGAGCTGATTATTACTGCCAGTCCTATGACACAGCAGTCCTA GTTGGGGTGTTCGGCGGAGGGACCAAGCTGACCGTCCTA |
| 1358 | VH-VL of CDH19 14057 | artificial | AA | QVQLQESGPGLVKPSETLSLTCTVSGGSISGYYWSWIRQPPGKGLEWIGYIFSYSGSTNYNPSLKSRVTLSVDTSKNQFSLKLSSVT AADTAVYYCARNWAFHPDFWGQGTILVTVSSGGGGSGGGGSGGGGSQSVLTQPPSVSGAPGQRVTISCTGSSSNIGTGYAVHWYQQL PGTAPKLLIYGNNNRPSGVPDRFSGSKSGTSASLAITGLQAEDEADYYCQSYDSRLSGWVFGGGTKLTVL |
| 1359 | CDH19 14057 x I2C | artificial | aa | QVQLQESGPGLVKPSETLSLTCTVSGGSISGYYWSWIRQPPGKGLEWIGYIFSYSGSTNYNPSLKSRVTLSVDTSKNQFSLKLSSVT AADTAVYYCARNWAFHPDFWGQGTILVTVSSGGGGSGGGGSGSVLTQPPSVSGAPGQRVTISCTGSSSNIGTGYAVHWYQQL PGTAPKLLIYGNNNRPSGVPDRFSGSKSGTSASLAITGLQAEDEADYYCQSYDSRLSGWVFGGGTKLTVLSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALITLSGVQPEDEAEYYCVLWYSNRWVFGGGTKLTVLHHHHHH |
| 1360 | CDR-H1 of CDH19 14049 | artificial | AA | SYSWS |
| 1361 | CDR-H2 of CDH19 14049 | artificial | AA | YIYYSGSTNYNPSLKS |
| 1362 | CDR-H3 of CDH19 14049 | artificial | AA | NWAFHPDY |
| 1363 | CDR-L1 of CDH19 14049 | artificial | AA | TGSSSNIGTGYDVH |
| 1364 | CDR-L2 of CDH19 14049 | artificial | AA | GNSNRPS |
| 1365 | CDR-L3 of CDH19 14049 | artificial | AA | QSYDSSLSGWV |
| 1366 | VH of CDH19 14049 | artificial | nt | CAGGTGCAGCTGCAGGAGTCGGGCCCAGGACTGGTGAAGCCTTCCGAGACACCCTGTCCTCACTGCACTGTCTCTGGTGGCTCCAT CAGTAGTTACTCCTGGAGCTGGATCCGCCAGCCCCCAGGGAAGGGACTGGAGTGGATTGGGTATATCTATTACAGTGGGAGCACCA ACTACAACCCCTCCCTCAAGAGTCGAGTCACCATATCAGTAGACACGTCCAAGAACCAGTTCTCCCTGAAGCTGAGCTCTGTGACC GCTGCCGACACGGCCGTGTATTACTGTGCGAGAAACTGGGCTTTCCACTTTGACTACTGGGGCCAGGGAACCCTGGTCACCGTCTC TAGT |
| 1367 | VH of CDH19 14049 | artificial | AA | QVQLQESGPGLVKPSETLSLTCTVSGGSISYSWSWIRQPPGKGLEWIGYIYYSGSTNYNPSLKSRVTISLDTSKNQFSLKLSSVT AADTAVYYCARNWAFHPDYWGQGTLVTVSS |
| 1368 | VL of CDH19 14049 | artificial | nt | CAGTCTGTCTGACGCAGCCGCCCTCAGTGTCTGGGCTCCAGGGGAGACAGAGGTCACCATCTCCTGCACTGGGAGCAGCTCCAATAT CGGAACAGGTTATGATGTAGACCAGTGGTACCAGCAGCTTCCAGGAACAGCCCCCAAACTCCTCATCTATGGTAACAGCAATCGGCCCT CAGGGGTCCCTGACCGATTCTCTGGCTCCAAGTCTGGCACCTCAGCCTCCCTGGCCATCACTGGGCTCCAGGCTGAGGATGAGGCT GATTATTACTGCCAGTCCTATGACAGCAGTCTGAGTGGTTGGGTGTTCGGCGGAGGGACCAAGCTGACCGTCCTA |
| 1369 | VL of CDH19 14049 | artificial | AA | QSVLTQPPSVSGAPGQRVTISCTGSSSNIGTGYDVHWYQQLPGTAPKLLIYGNSNRPSGVPDRFSGSKSGTSASLAITGLQAEDEA DYYCQSYDSSLSGWVFGGGTKLTVL |

TABLE VI-continued

| SEQ ID NO. | DESIGNATION | SOURCE | TYPE | SEQUENCE |
|---|---|---|---|---|
| 1370 | VH-VL of CDH19 14049 | artificial | nt | CAGGTGCAGCTGCAAGAGTCGGGCCCAGGACTGGTGAAGCCTTCACAGACCCTGTCCCTCACCTGCACTGTCTCTGGTGGCTCCAT CAGTAGTACTCCTGAGACTGGAGCTGGATCCGGCAGCCCCCAGGGAAGGGACTGGAGTGGATTGGGTATATCTATTACAGTGGAGCACCA ACTACAACCCCTCCCTCAAGAGTCGAGTCACCATATCAGATAGACGTCCAAGAACCAGTTCTCCCTGAAGCTGAGCTCTGTGACC GCTGCGACACGGCCGTGTATTACTGCGCGAGAGTGAAGCGGAGGCCCTTCCACTTGACTACTGTGTGTGCCAGGTCCTCACCGTCTC TAGTGGTGGCGACAGATCTGCCGAGGTGAAGCGGAGGCGGCAGCTCCAATATCGGGACAGCTCCAATATCGGCCTGTGAGCTTATGATGGAAGCTTATGATGGAAGCTTATGATGGAAGCTTTGGG CCCCAGGGACAGAGGGTTCACCATCTCCGTGACTGGAGCAGCTCCAATATCGGCCTCTGTGCTGACCGATTCTGCTCAAGTCTGG CACCTCAGCCTCCCTGCCCAAATCTGAAGATGAGGCTGAGATCACCTATTACTGCGGAACAGCAGCAGCAGCAGTGGAGTG GTTGGGTGTTCCGCGAGGACCAGGTTGACCGTCTA |
| 1371 | VH-VL of CDH19 14049 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQVLTQPPSVSGAPGQRVTISCTGSSSNIGTGYDVHWYQQL PGTAPKLLIYGNSNRPSGVPDRFSGSKSGTSASLAITGLQAEDEADYYCQSYDSSLSGWVFGGGTRLTVL |
| 1372 | CDH19 14049 x I2C | artificial | aa | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQVLTQPPSVSGAPGQRVTISCTGSSSNIGTGYDVHWYQQL PGTAPKLLIYGNSNRPSGVPDRFSGSKSGTSASLAITGLQAEDEADYYCQSYDSSLSGWVFGGGTRLTVLSGGGGSEVQLVESGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1373 | CDR-H1 of CDH19 14302 | artificial | AA | SYGMH |
| 1374 | CDR-H2 of CDH19 14302 | artificial | AA | FIWYDGSNKYYADSVKD |
| 1375 | CDR-H3 of CDH19 14302 | artificial | AA | RAGIIGTIGYYYGMDV |
| 1376 | CDR-L1 of CDH19 14302 | artificial | AA | SGDRLGEKYTS |
| 1377 | CDR-L2 of CDH19 14302 | artificial | AA | QDTKRPS |
| 1378 | CDR-L3 of CDH19 14302 | artificial | AA | QAWESSTVV |
| 1379 | VH of CDH19 14302 | artificial | nt | CAGGTGCAGTTGGTGGAGTCTGGGGGAGGCGTGGTCCAGCCTGGGAGGTCCCTGAGACTCTCCTGTGCAGCTTCTGGATTCACCTT CAGTAGCTATGGCATGCACTGGGTCCGCCAGGCTCCAGGCAAGGGGCTGGAGTGGGTGGCATTTATATGGTATGATGGAAGTAATA AATACTATGCAGACTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAGGGGTATAATAGGAACTATACGGTATGACGTCTG GGGCCAAGGGACCACGGTCACCGTCTCTAGT |
| 1380 | VH of CDH19 14302 | artificial | AA | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSS |
| 1381 | VL of CDH19 14302 | artificial | nt | TCCTATGAACTGACTCAGCCACCCTCAGTGTCCGTGTCCCCAGGACAGACAGCCATCACCTGCTCTGGAGATAGGTTGGGGA AAATATACTAGCTGGTATCAGCAGAAGCCAGGCCAGTCCCCTTTGCTGGTCATCTATCAAGATACCAAGCGCCCTCAGGGATCC |

TABLE VI-continued

| SEQ ID NO. | DESIGNATION | SOURCE | TYPE | SEQUENCE |
|---|---|---|---|---|
| | | | | CTGAGCGATTCTCGGCTCCAACTCTGGTAACACAGCCACTCTGACCATCAGCGGGACCCAGGCTATGGATGAGGCTGACTATTAC TGTCAGGCGTGGGAGAGCAGCACTGTGGTATTCGGCGGAGGGACCAAGCTGACCGTCCTA |
| 1382 | VL of CDH19 14302 | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGGGTKLTVL |
| 1383 | VH-VL of CDH19 14302 | artificial | nt | CAGGTCAGTTGGTGAGTGGGGAGGCTGGTCCAGCCTGGGGGGTCCCTGAGACTCTCCTGTGCAGCGTCTGGATTCACCTT CAGTAGTATGGCATGCACTGGGTCCGCCAGGCTCCAGGCAAGGGGCTGGAGTGGGTGGCATTTATATGGTATGAGGAAGTAATA AATACTATGCAGAGCTGAAGGACAGATTCACCATCTCCAGAGACAATTCCAAGAACACGCTGTATCTGCAAATGAATAGCCTG AGAGCTGAGGACACGGCTGTGTATTACTGTGCGAGAAGGCCGGTATAATAGGAACTATAGGCTACTACTACGGTATGGACGTCTG GGGCCAAGGGACCACCGTCACCGTCTCAGTGTCCGGTGGAGGCGGTTCAGGCGGAGGTGGCTCTGGCGGTGGCGGATCGCAGGT CTCTGGCTCCAACTCTGGTAACACAGCCACTCTGACCATCAGCGGGACCCAGGCTATGGATGAGGCTGACTATTACTGTCAGGCGT GGGAGAGCAGCACTGTGGTATTCGGCGGAGGGACCAAGCTGACCGTCCTA |
| 1384 | VH-VL of CDH19 14302 | artificial | AA | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVL |
| 1385 | CDH19 14302 x I2C | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLHHHHHH |
| 1386 | CDR-H1 of CDH19 14303 | artificial | AA | SYGMH |
| 1387 | CDR-H2 of CDH19 14303 | artificial | AA | FIWYEGSNKYYAESVKD |
| 1388 | CDR-H3 of CDH19 14303 | artificial | AA | RAGIIGTIGYYYGMDV |
| 1389 | CDR-L1 of CDH19 14303 | artificial | AA | SGDRLGEKYTS |
| 1390 | CDR-L2 of CDH19 14303 | artificial | AA | QDTKRPS |
| 1391 | CDR-L3 of CDH19 14303 | artificial | AA | QAWESSTVV |
| 1392 | VH of CDH19 14303 | artificial | nt | CAGGTCAGTTGGTGAGTGCATGGAGGCTGGTCCAGCCTGGGAGGTCCCTGAGACTCTCCTGTGCAGCGTCTGGATTCACCTT CAGTAGTATGGCATGCACTGGGTCCGCCAGGCTCCAGGCAAGGGGCTGGAGTGGGTGGCATTTATATGGTATGAGGGAAGTAATA AATACTATGCAGAGTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAAGGCCGGTATAATAGGAACTATAGGCTACTACTACGGTATGGACGTCTG GGGCCAAGGGACCACCGTCACCGTCTCTAGT |

TABLE VI-continued

| SEQ ID NO. | DESIGNATION | SOURCE | TYPE | SEQUENCE |
|---|---|---|---|---|
| 1393 | VH of CDH19 14303 | artificial | AA | QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSS |
| 1394 | VL of CDH19 14303 | artificial | nt | TCCTATGAACTGACTCAGCCACCCTCAGTGTCCGTGTCCCCAGGACAGAGGGCCAGCCAGAGCATCACCTGCTCTGGAGATAGGTTGGGGAAAAATATACTAGCTGGTATCAGCAGAGGCCAGGCCAGTCCCCTTGTCATCTATCAAGATACCAAGGCGCCCTCAGGGATCCCTGAGCGGATTCTCTGGCTCCAACTCTGGTAACACAGCACTCTGACCATCAGCGGACCCAGGCTATGGATGAGGCTGACTATTACTGTCAGGCGTGGGAGAGCAGCACTGTGGTATTCGGCGGAGGGACCAAGCTGACCGTCCTA |
| 1395 | VL of CDH19 14303 | artificial | AA | SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL |
| 1396 | VH-VL of CDH19 14303 | artificial | nt | CAGGTGCAGTTGGTGGAGTCTGGGGGAGGCGTGGTCCAGCCTGGGAGGTCCCTGAGACTCTCCTGTGCAGCCTCTGGATTCACCTTCAGTAGCTATGGCATGCACTGGGTCCGCCAGGCTCCAGGCAAGGGGCTGGAGTGGGTGGCATTTATATGGTATGAGGGAAGTAATAAATACTATGCAGACTCCGTGAAGGACCGATTCACCATCTCCAGAGACAATTCCAAGAACACGCTGTATCTGCAAATGAAAAGCCTGAGAGCTGAGGACACAGCCGTGTATTACTGTGCGAGAGACGGTATAATAGGAACTATAGGCTACTACGGTATGGACGTCTGGGGCCAAGGGACCACGGTCACCGTCTCCTCAGGTGGAGGCGGTTCAGGCGGAGGTGGCTCTGGCGGTGGCGGATCGTCCTATGAACTGACTCAGCCACCCTCAGTGTCCGTGTCCCCAGGACAGACAGCCAGCATCACCTGCTCTGGAGATAGGTTGGGGAAAAATATACTAGCTGGTATCAGCAGAGGCCAGGCCAGTCCCCTTGTCATCTATCAAGATACCAAGCGGCCCTCAGGGATCCCTGAGCGATTCTCTGGCTCCAACTCTGGTAACACAGCCACTCTGACCATCAGCGGGACCCAGGCTATGGATGAGGCTGACTATTACTGTCAGGCGTGGGAGAGCAGCACTGTGGTATTCGGCGGAGGGACCAAGCTGACCGTCCTA |
| 1397 | VH-VL of CDH19 14303 | artificial | AA | QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL |
| 1398 | CDH19 14303 x I2C | artificial | aa | QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSQTVTQEPSLTVSPGGTVLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1399 | CDR-H1 of CDH19 14078 | artificial | AA | RYGIH |
| 1400 | CDR-H2 of CDH19 14078 | artificial | AA | VIWYDGSNKYYADSVKG |
| 1401 | CDR-H3 of CDH19 14078 | artificial | AA | RAGIPGTTGYYYGMDV |
| 1402 | CDR-L1 of CDH19 14078 | artificial | AA | SGDRLGEKYVS |
| 1403 | CDR-L2 of CDH19 14078 | artificial | AA | QDNKWPS |
| 1404 | CDR-L3 of CDH19 14078 | artificial | AA | QAWDSSTVV |

TABLE VI-continued

| SEQ ID NO. | DESIGNATION | SOURCE | TYPE | SEQUENCE |
|---|---|---|---|---|
| 1405 | VH of CDH19 14078 | artificial | nt | CAGGTCAGCTGGTGGAGTCTGGGGGAGGCGTGGTCCAGCCTGGGGGGTCCCTGAGACTCTCCTGTGCAGCGTCTGGATTCACCTTCAGTCGCTATGCCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACTCGGCTGTGTATTACTGTGCGAGAGGGCCGGTATACTGGAGAACTCTGGACTTTGACTTACTATGGTATGGACGTCTGGGGCCAAGGGACCACGGTCACCGTCTCCTCA |
| 1406 | VH of CDH19 14078 | artificial | AA | QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSS |
| 1407 | VL of CDH19 14078 | artificial | nt | TCCTATGAGCTGACTCAGCCACCCTCAGTGTCCGTGTCCCCAGGACAGACAGCCAGCATCACCTGCTCTGGAGATAGATTGGGGAGAAATATGTTAGCTGGTATCAGCAGAAGCCAGGCCAGTCCCCTATCGTGGTCATCTATCAAGATAATAAGTGGCCCTCAGGGATCCCTGAGCGATTCTCTGGAACACAGCCACTCTGGACAACATCAGCACTTGACCATCAGCGGGACCCAGGCTATGGATGAGGCTGACTATTACTGTCAGGCGTGGGACAGCAGCACTGTGGTATTCGGCGGAGGGACCAAGCTGACCGTCCTA |
| 1408 | VL of CDH19 14078 | artificial | AA | SYELTQPPSVSVSPGQTASITCSGDRLGEKYVSWYQQKPGQSPILVIYQDNKWPSGIPERFSGSNSGNTATLTISGTQAMDEADYYCQAWDSSTVFGGGTKLTVL |
| 1409 | VH-VL of CDH19 14078 | artificial | nt | CAGGTCAGCTGGTGGAGTCTGGGGGAGGCGTGGTCCAGCCTGGGGGGTCCCTGAGACTCTCCTGTGCAGCGTCTGGATTCACCTTCAGTCGCTATGCCATGCACTGGGTCCGCCAGGCTCCAGGCAAGGGGCTGGAGTGGGTGGCAGTTATATGGTATGATGGAAGTAATAAATACTATGCAGACTCCGTGAAGGGCCGATTCACCATCTCCAGAGACAATTCCAAGAACACGCTGTATCTGCAAATGAACAGCCTGAGAGCCGAGGACACCGCTGTGTATTACTGTGCGAGAGGGCCGGATCTGGCGAGGTGAAGCGGAGGGATTCTCTGAGAGCAGTCTAGCCAGTCCAGGACAGACAGCCAGCATCACCTGCTCTGGAGATAGATTGGGGAGAAATATGTTAGCTGGTATCAGCAGAAGCCAGGCCAGTCCCCTATCGTGGTCATCTATCAAGATAATAAGTGGCCCTCAGGGATCCCTGAGCCGATTCTCTGGCTCCAACTCTGGGAACACAGCCACTCTGGACAACATCAGCGGGACCCAGGCTATGGATGAGGCTGACTATTACTGTCAGGCGTGGGACAGCAGCACTGTGGTATTCGGCGGAGGGACCAAGCTGACCGTCCTA |
| 1410 | VH-VL of CDH19 14078 | artificial | AA | QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSSYELTQPPSVSPGQTASITCSGDRLGEKYVSWYQQKPGQSPILVIYQDNKWPSGIPERFSGSNSGNTATLTISGTQAMDEADYYCQAWDSSTVFGGGTKLTVL |
| 1411 | CDH19 14078 x I2C | artificial | aa | QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSYELTQPPSVSPGQTASITCSGDRLGEKYVSWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1412 | CDR-H1 of CDH19 14080 | artificial | AA | RYGIH |
| 1413 | CDR-H2 of CDH19 14080 | artificial | AA | VIWYDGSNKYYADSVKG |
| 1414 | CDR-H3 of CDH19 14080 | artificial | AA | RAGIPTTGYYYGMDV |
| 1415 | CDR-L1 of CDH19 14080 | artificial | AA | SGDRLGEKYVY |

TABLE VI-continued

| SEQ ID NO. | DESIGNATION | SOURCE | TYPE | SEQUENCE |
|---|---|---|---|---|
| 1416 | CDR-L2 of CDH19 14080 | artificial | AA | QDNKWPS |
| 1417 | CDR-L3 of CDH19 14080 | artificial | AA | QAWDSSTVV |
| 1418 | VH of CDH19 14080 | artificial | nt | CAGGTCCAGCTGGTGGAGTCTGGGGGAGGCGTGGTCCAGCCTGGGAGGTCCCTGAGACTCTCCTGTGCAGCTGTCTGGATTCACCTT CAGTCGCTATGCCATGACCTGGGTCCGCCAGGCTCCAGGCAAGGGCCTGGAGTGGGTGGCAGTTATATGGTATGATGGAAGTAATA AATACTATGCAGACTCCGTGAAGGGCCGATTCACCATCTCGAGAGACAATTCCAAGAACACGCTGTATCTGCAAATGAACAGCCTG AGAGCCGAGGACTCGGCTGTGTATTACTGTGCGAGAAGGGCCGTATAACCTGGAACTACGGGCTACTACTATGGTATGGACGTCTG GGGCCAAGGGACCACGGTCACCGTCTCCTCA |
| 1419 | VH of CDH19 14080 | artificial | AA | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSS |
| 1420 | VL of CDH19 14080 | artificial | nt | TCCTATGAGCTGACTCAGCCACCCTCAGTGTCCGTGTCCCCAGGACAGACAGCCAGCATCACCTGCTCTGGAGATAGATTGGGGGA GAAATATGTTTACTGGTATCAGCAGAAGCCAGGCCAGTCCCCTATACTGGTCATCTATCAAGATATAAGTGCCCTCAGGGATCC CTGAGCCATTCTCGGCTCCAACTCTGGGAACACAGCCACTCTGACCATCAGCGGGACCCAGGCTATGGATGAGGCTGACTATTAC TGTCAGGCGTGGACAGCAGCAGTCTGGTATTCGGCGGAGGGACCAAGCTGACCGTCCTA |
| 1421 | VL of CDH19 14080 | artificial | AA | SYELTQPPSVSVSPGQTASITCSGDRLGEKYVYWYQQKPGQSPILVIYQDNKWPSGIPERFSGSNSGNTATLTISGTQAMDEADYY CQAWDSSTVVFGGGTKLTVL |
| 1422 | VH-VL of CDH19 14080 | artificial | nt | CAGGTCCAGCTGGTGGAGTCTGGGGGAGGCGTGGTCCAGCCTGGGAGGTCCCTGAGACTCTCCTGTGCAGCTGTCTGGATTCACCTT CAGTCGCTATGCCATGACCTGGGTCCGCCAGGCTCCAGGCAAGGGCCTGGAGTGGGTGGCAGTTATATGGTATGATGGAAGTAATA AATACTATGCAGACTCCGTGAAGGGCCGATTCACCATCTCCAAGAGACAATTCCAAGAACACGCTGTATCTGCAAATGAACAGCCTG AGAGCCGAGGACTCGGCTGTGTATTACTGTGCGAGGGCCGGATCTGGAGGTGGAAGCGGAGGCGGGATCTTCCTATGAGC TGACTCAGCCACCCTCAGTGTCCGTGTCCCCAGGACAGACAGCCAGCATCACCTGCTCTGGAGATAGATTGGGGGAAAATATGT TACTGGTATCAGCAGAAGCCAGGCCAGTCCCCTATACTGGTCATCTATCAAGATATAAGTGGCCCTCAGGGATCCCTGAGCGATT CTCGGCTCCAACTCTGGGAACACAGCCACTCTGACCATCAGCGGGACCCAGGCTATGGATGAGGCTGACTATTACTGTCAGGCGT GGGACAGCAGCAGTCTGGTATTCGGCGGAGGGACCAAGCTGACCGTCCTA |
| 1423 | VH-VL of CDH19 14080 | artificial | AA | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSSGGGGSGGGGSGGGGSSYELTQPPSVSVSPGQTASITCSGDRLGEKYV YWYQQKPGQSPILVIYQDNKWPSGIPERFSGSNSGNTATLTISGTQAMDEADYYCQAWDSSTVVFGGGTKLTVL |
| 1424 | CDH19 14080 × I2C | artificial | aa | QVQLVESGGGVVQPGRSLRLSCAASGFTFSRYGIHWVRQAPGKGLEWVAVIWYDGSNKYYADSVKGRFTISRDNSKNTLYLLMNSL RAEDSAVYYCARRAGIPGTTGYYYGMDVWGQGTTVTVSSGGGGSGGGGSGGGGSSYELTQPPSVSVSPGQTASITCSGDRLGEKYV YWYQQKPGQSPILVIYQDNKWPSGIPERFSGSNSGNTATLTISGTQAMDEADYYCQAWDSSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1425 | CDR-H1 of CDH19 13591 | artificial | AA | SYSWS |
| 1426 | CDR-H2 of CDH19 13591 | artificial | AA | YIYYSGSTNYNPSLKS |

TABLE VI-continued

| SEQ ID NO. | DESIGNATION | SOURCE | TYPE | SEQUENCE |
|---|---|---|---|---|
| 1427 | CDR-H3 of CDH19 13591 | artificial | AA | NWAFHFDY |
| 1428 | CDR-L1 of CDH19 13591 | artificial | AA | TGSSSNIGTGYDVH |
| 1429 | CDR-L2 of CDH19 13591 | artificial | AA | GNSNRPS |
| 1430 | CDR-L3 of CDH19 13591 | artificial | AA | QSYDSSLSGWV |
| 1431 | VH of CDH19 13591 | artificial | nt | CAGGTGCAGCTGCAGGAGTCGGGCCCAGGACTGGTGAAGCCTTCGGAGACCCTGTCCCTCACCTGCACTGTCTCTGGTGGCTCCAT CAGTAGTTACTCCTGGAGCTGGATCCGGCAGCCCCCAGGGAAGGGACTGGAGTGGATTGGGTATATCTATTACAGTGGGAGCACCA ACTACAACCCCTCCCTCAAGAGTCGAGTCACCATATCATTAGACACGTCCAAGAACCAGTTCTCCCTGAAGCTGAGCTCTGTGACC GCTGCGACACGGCCGTGTATTACTGTGCGAGAAACTGGGCTTCCACTTTGACTACTGGGGCCAGGGAACCCTGGTCACCGTCTC TAGT |
| 1432 | VH of CDH19 13591 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSS |
| 1433 | VL of CDH19 13591 | artificial | nt | CAGTCTGTGTTGACGCAGCCGCCCTCAGTGTCTGGGGCCCCAGGGCAGAGGGTCACCATCTCCTGCACTGGGAGCAGCTCCAATAT CGGGACAGGTTATGATGTAGACTGGTACCAGCAGCTTCCAGGAACAGCCCCCAAACTCCTCATCTATGGTAACAGCAATCGGCCCT CAGGGGTCCCTGACCGATTCTCTGGCTCCAAGTCTGGCACCTCAGCCTCCCTGGCCATCACTGGGCTCCAGGCTGAGGATGAGGCT GATTATTACTGCCAGTCCTATGACAGCAGTCTGAGTGGTTGGGTGTTCGGCGGAGGGACCAAGGTTGACCGTCCTA |
| 1434 | VL of CDH19 13591 | artificial | AA | QSVLTQPPSVSGAPGQRVTISCTGSSSNIGTGYDVHWYQQLPGTAPKLLIHGNSNRPSGVPDRFSGSKSGTSASLAITGLQAEDEA DYYCQSYDSSLSGWVFGGGTRLTVL |
| 1435 | VH-VL of CDH19 13591 | artificial | nt | CAGGTGCAGCTGCAGGAGTCGGGCCCAGGACTGGTGAAGCCTTCGGAGACCCTGTCCCTCACCTGCACTGTCTCTGGTGGCTCCAT CAGTAGTTACTCCTGGAGCTGGATCCGGCAGCCCCCAGGGAAGGGACTGGAGTGGATTGGGTATATCTATTACAGTGGGAGCACCA ACTACAACCCCTCCCTCAAGAGTCGAGTCACCATATCATTAGACACGTCCAAGAACCAGTTCTCCCTGAAGCTGAGCTCTGTGACC GCTGCGACACGGCCGTGTATTACTGTGCGAGAAACTGGGCTTCCACTTTGACTACTGGGGCCAGGGAACCCTGGTCACCGTCTC TAGTGGTGGCGGAGGTTCAGGCGGAGGTGGCAGCGGCGGTGGCGGATCTCAGTCTGTGTTGACGCAGCCGCCCTCAGTGTCTGGG GCCCCAGGGCAGAGGGTCACCATCTCCTGCACTGGGAGCAGCTCCAATATCGGGACAGGTTATGATGTAGACTGGTACCAGCAGCTT CCAGGAACAGCCCCCAAACTCCTCATCTATGGTAACAGCAATCGGCCCTCAGGGGTCCCTGACCGATTCTCTGGCTCCAAGTCTGG CACCTCAGCCTCCCTGGCCATCACTGGGCTCCAGGCTGAGGATGAGGCTGATTATTACTGCCAGTCCTATGACAGCAGTCTGAGTG GTTGGGTGTTCGGCGGAGGGACCAAGGTTGACCGTCCTA |
| 1436 | VH-VL of CDH19 13591 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL PGTAPKLLIHGNSNRPSGVPDRFSGSKSGTSASLAITGLQAEDEADYYCQSYDSSLSGWVFGGGTRLTVL |
| 1437 | CDH19 13591 x I2C | artificial | aa | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL PGTAPKLLIHGNSNRPSGVPDRFSGSKSGTSASLAITGLQAEDEADYYCQSYDSSLSGWVFGGGEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQGTLVTVSSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |

TABLE VI-continued

| SEQ ID NO. | DESIGNATION | SOURCE | TYPE | SEQUENCE |
|---|---|---|---|---|
| 1438 | CDR-H1 of CDH19 14299 | artificial | AA | SYSWS |
| 1439 | CDR-H2 of CDH19 14299 | artificial | AA | YIYYSGSTNYNPSLKS |
| 1440 | CDR-H3 of CDH19 14299 | artificial | AA | NWAFHFDY |
| 1441 | CDR-L1 of CDH19 14299 | artificial | AA | TGSSSNIGTGYDVH |
| 1442 | CDR-L2 of CDH19 14299 | artificial | AA | GNSNRPS |
| 1443 | CDR-L3 of CDH19 14299 | artificial | AA | QSYDSSLSGWV |
| 1444 | VH of CDH19 14299 | artificial | nt | CAGGTGCAGCTGCAGGAGTCGGGCCCAGGACTGGTGAAGCCTTCGGAGACCCTGTCCTCACCTGCACTGTCTCTGGTGGCTCCAT CAGTAGTTACTCCTGGAGCTGGATCCGGCAGCCCCCAGGGAAGGGACTGGAGTGGATTGGGTATATCTATTACAGTGGGAGCACCA ACTACAACCCCTCCCTCAAGAGTCGAGTCACCATATCATTAGACACGTCCAAGAACCAGTTCTCCCTGAAGCTGAGCTCTGTGACC GCTGCGGACACGGCCGTGTATTACTGTGCGAGGAACTGGGCCTTCCACTTTGACTACTGGGGCCAGGGAACCCTGGTCACCGTCTC TAGT |
| 1445 | VH of CDH19 14299 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSS |
| 1446 | VL of CDH19 14299 | artificial | nt | CAGTCTGTGCTGACGCAGCCGCCCTCAGTGTCTGGGGCCCCAGGGCAGAGGGTCACCATCTCCTGCACTGGGAGCTCCAATAT CGGGACAGGTTATGATGTACACTGGTATCAGCAGCTTCCAGGAACAGCCCCCAAACTCCTCATCTATGGTAACAGCAATCGGCCCT CAGGGGTCCCTGACCGATTCTCTGGCTCCAAGTCTGGCACCTCAGCCTCCCTGGCCATCACTGGGCTCCAGTCTGAGGATGAGGCT GATTATTACTGCCAGTCCTATGACAGCAGCCTGAGTGGTTCGGCGGAGGGACCAAGGTTGACCGTCCTA |
| 1447 | VL of CDH19 14299 | artificial | AA | QSVLTQPPSVSGAPGQRVTISCTGSSSNIGTGYDVHWYQQLPGTAPKLLIHGNSNRPSGVPDRFSGSKSGTSASLAITGLQAEDEA DYYCQSYDSSLSGWVFGGGTRLTVL |
| 1448 | VH-VL of CDH19 14299 | artificial | nt | CAGGTGCAGCTGCAGGAGTCGGGCCCAGGACTGGTGAAGCCTTCGGAGACCCTGTCCTCACCTGCACTGTCTCTGGTGGCTCCAT CAGTAGTTACTCCTGGAGCTGGATCCGGCAGCCCCCAGGGAAGGGACTGGAGTGGATTGGGTATATCTATTACAGTGGGAGCACCA ACTACAACCCCTCCCTCAAGAGTCGAGTCACCATATCATTAGACACGTCCAAGAACCAGTTCTCCCTGAAGCTGAGCTCTGTGACC GCTGCGGACACGGCCGTGTATTACTGTGCGAGGAACTGGGCCTTCCACTTTGACTACTGGGGCCAGGGAACCCGCCTGGTCTGGGG TAGTGGTGGCGGAGGATCTGGCGGAGGTGGAAGCGGAGGTGGATCAGGTGGTGGTGGATCTCAGTCTGTGCTGACGCAGCCGCCCT CCAGGGACAGAGGGTCACCATCTCCTGCACTGGGAGCAGCTCCAATATCGGGACAGGTTATGATGTACACTGGTATCAGCAGCTT CCAGGAACAGCCCCCAAACTCCTCATCTATGGTAACAGCAATCGGCCCTCAGGGGTCCCTGACCGATTCTCTGGCTCCAAGTCTGG CACCTCAGCCTCCCTGGCCATCACTGGGCTCCAGTCTGAGGATGAGGCTGATTATTACTGCCAGTCCTATGACAGCAGTCTGAGTG GTTGGGTGTTCGGCGGAGGGACCAAGGTTGACCGTCCTA |
| 1449 | VH-VL of CDH19 14299 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL PGTAPKLLIHGNSNRPSGVPDRFSGSKSGTSASLAITGLQAEDEADYYCQSYDSSLSGWVFGGGTRLTVL |
| 1450 | CDH19 14299 × I2C | artificial | aa | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL |

TABLE VI-continued

| SEQ ID NO. | DESIGNATION | SOURCE | TYPE | SEQUENCE |
|---|---|---|---|---|
| | | | | PGTAPKLLIHGNSNRPSGVPDRFSGSKSGTSASLAITGLQAEDEADYYCQSYDSSLSGWVFGGGTRLTVLSGGGGSEVQLVESGGG LVQPGGSLKLSCAASGFTFNKYAMWVRQAPGKGLEWVARIRSKYNNYATYYADSVKDRFTISRDDSKNTAYLQMNNLKTEDTAVY YCVRHGNFGNSYISTWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1451 | ckCDH19 (1-43):: FLAG::ckCDH19 (44-776) | artificial | aa | MNCSTFLSLVLALVQLQLCSPTTQIFSAQKTDQSYTTIRRVKRDYKDDDDKGWVWEPLFVTEEETSTMPMYVGQLKSDLLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATDGDDPSYGNNARLLYSLLIQGQPYFSVEPKTGVIRMTSQMDRETKDQYLVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPVFTLESYVMEIAEGVVSGSLVGTVSARDLDNDSSVRYSIVQGLHLKRLFSINE HNGTIITTEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYFFLPLILLDNGSPPLTSNTLTVTVCCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MYTSQRSTRD |
| 1452 | huCDH19 (1-43):: FLAG::hu (44-141):: ckCDH19 (142-776) | artificial | aa | MNCYLLLRFMLGIPLLWPCLGATENSQTKKVKQPVRSHLRVKRDYKDDDDKGWVWNQFFVPEEMNTTSHHIGQLRSDLDNGNNSFQ YKLLGAGAGSTFIIDERTGDIYAIQKLDREERSLYILIQGQPYFSVEPKTGVIRMTSQMDRETKDQYLVVIQAKDMVGQAGAFSATATVTINLSDVN TSVTQVTATDGDDPSYGNNARLLYSLLIQGQPYFSVEPKTGVIRMTSQMDRETKDQYLVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPVFTLESYVMEIAEGVVSGSLVGTVSARDLDNDSSVRYSIVQGLHLKRLFSINE HNGTIITTEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYFFLPLILLDNGSPPLTSNTLTVTVCCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MYTSQRSTRD |
| 1453 | ckCDH19 (1-43):: FLAG::ckCDH19 (44-141):: huCDH19 (142-249):: ckCDH19 (250-776) | artificial | aa | MNCSTFLSLVLALVQLQLCSPTTQIFSAQKTDQSYTTIRRVKRDYKDDDDKGWVWEPLFVTEEETSTMPMYVGQLKSDLLDKEDGSL QYILTGEGADSIFFINEHGKIYVRQKLDREKKSFYILRAQVINRKTRHPIEPDSEFIIKVRDINDNEPKFLDEPYEAIVPEMSPEG TLVIQVTASDADDPSSGNNARLLYSLLIQGQPYFSVEPTTGVIRISSKMDRELQDEYWVIIQAKDMIGQPGALSGTTSVLIKLSDVN DNPPKFQQRLYYLNVSEEAPVGTTVGRLLAEDSDIGENAAMNYFIEEDSSDVFGIITDRETQEGIIILKKRVDYESKRKHSVRVKA VNRYIDDRFLKEGPFEDITIVQISVVDADEPPVFTLESYVMEIAEGVVSGSLVGTVSARDLDNDSSVRYSIVQGLHLKRLFSINE HNGTIITTEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYFFLPLILLDNGSPPLTSNTLTVTVCCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MYTSQRSTRD |
| 1454 | ckCDH19 (1-43):: FLAG::ckCDH19 (44-249):: huCDH19 (250-364):: ckCDH19 (365-776) | artificial | aa | MNCSTFLSLVLALVQLQLCSPTTQIFSAQKTDQSYTTIRRVKRDYKDDDDKGWVWEPLFVTEEETSTMPMYVGQLKSDLLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATDGDDPSYGNNARLLYSLLIQGQPYFSVEPKTGVIRMTSQMDRETKDQYLVVIQAKDMVGQAGAFSATATVTINLSDVN DNKPIFKESLYRLTVSEEAPVGTSIGTIMAYDNDIGENAAEMDYSIEEDDSQTFDIITNHETQEGIILKKRVDFEHQNHYGIRAKV KNHVPEQLMKYHTEASTTFIKIQVEDVDEPPVFTLESYVMEIAEGVVSGSLVGTVSARDLDNDSSVRYSIVQGLHLKRLFSINE HNGTIITTEPLDREKASWHNITVTATETRNPEKISEANVYIQVLDVNDHAPEFSKYYETFVCENAVPGQLIQNISAVDKDDSAENH RFYFSLAQATNSSHFTVKDNQDNTAGIFTAGSGFSRKEQFYFFLPLILLDNGSPPLTSNTLTVTVCCDTEVNTLYCRYGAFLYS IGLSTEALVAVLACLLILLVFFLAIIGIRQQRKKTLFSEKVEEFRENIVRYDDEGGEEDTEAFDISALRTRAVLRTHKPRKKITT EIHSLYRQSLQVGPDSAIFRQFISEKLEEANTDPSVPPYDSLQTYAFEGTGSLAGSLSSLGSNTSDVDQNYEYLVGWGPPFKQLAG MYTSQRSTRD |
| 1455 | ckCDH19 (1-43):: FLAG::ckCDH19 | artificial | aa | MNCSTFLSLVLALVQLQLCSPTTQIFSAQKTDQSYTTIRRVKRDYKDDDDKGWVWEPLFVTEEETSTMPMYVGQLKSDLLDKEDGSL QYILTGEGADSIFFINEHGKIYVRQKLDREKKSFYILRAQVINRKTRHPIEPDSEFIIKVRDINDHEPQFLDGPYVATVPEMSPEG |

TABLE VI-continued

| SEQ ID NO. | DESIGNATION | SOURCE | TYPE | SEQUENCE |
|---|---|---|---|---|
| | (44-364)::huCDH19 (365-463)::ckCDH19 (469-776) | | | TSVTQVTATGDDPSYGNNARLLYSLIQGQPYFSVEPKTGVIRMTSQMDRETKDQYIVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRHSVRVKA VNRYIDDRFLKEGPFEDITIVQISVDADEPPLFLLPYYVFEVFEETPQGSFVGVVSATDPDNRKSPIRYSITRSKVFNINDNGTI TTSNSLDREISAWYNLSITATEKYNIEQISSIPLVQVLNINDHAPEFSKYYETFVCENAVPGQLIQNISAVDKDDSAENHRFYFS LAQATNSSHFTVKDNQDNTAGIFTAGSGFSRKEQFYFFLPLILLDNGSPPLTSTNLTVTVCDCDTEVNTLYCRYGAFLYSIGLST EALVAVLACLLILLVFFLAIIGIRQQRKKTLFSEKVEEFRENIVRYDEGGGEEDTEAFDISALRTRAVLRTHKPRKKITTEIHSL YRQSLQVGPDSAIFRQFISEKLEEANTDPSVPPYDSLQTYAFEGTGSLAGSLSSLGSNTSDVDQNYEYLVGWGPPFKQLAGMYTSQ RSTRD |
| 1456 | (1-43)::FLAG::ckCDH19 (44-468::)::huCDH19 (464-772) | artificial | aa | MNCSTFLSLVLALVQLQLCSPTTQIFSAQKTDQSYTTIRRVKRDYKDDDDKGWVWEPLFVTEEETSTMPMVGQLKSDLDKEDGSL QYILTGEGADSIFFINEHGKIYVRQKLDREKKSFYILRAQVINRKTRHPIEPDSEFIIKVRDINDHEPQFLDGPYVATVPEMSPEG TSVTQVTATGDDPSYGNNARLLYSLIQGQPYFSVEPKTGVIRMTSQMDRETKDQYIVVIQAKDMVGQAGAFSATATVTINLSDVN DNPPKFQQRLYYLNVSEEAPVGTTVGRLLAEDSDIGENAAMNYFIEEDSSDVFGIITDRETQEGIIILKKRVDYESKRHSVRVKA VNRYIDDRFLKEGPFEDITIVQISVDADEPPVFTLESYVMEIAEGVVSGSLVGTVSARDILDNDSSVRYSIVQGLHLKRLFSINE HNGTIITTEPLDREKASWHNITVTATETRNPEKISEANVVIQVLDVNDHAPEFSQYYETVCENAGSGQVIQTISAVDRDESIEEH HFYFNLSVEDTNNSSFTIIDNQDNTAVILTNRTGFNLQEEPVFYISILIADNGIPSLTSTNTLTIHVCDCDSGSTQTCQYELVL SMGFKTEVIIALLICIMVIFGFIFLTLGLKQRRKQILFPEKSEDFRENIFQYDDEGGGEEDTEAFDIAELRSSTIMRERKTRKTTS AEIRSLYRQSLQVGPDSAIFRKFILEKLEEANTDPCAPPFDSLQTYAFEGTGSLAGSLSSLESAVSDQDESYDYLNELGPRFKRLA CMFGSAVQSNN |
| 1457 | rhCDH19 (1-43)::FLAG::rhCDH19 (44-772) | artificial | aa | MNCYLLLPFMLGIPLLMPCLGATENSQTKKVQQPVGSHLRVKRDYKDDDDKGWVMQFFVPEEMNTTSHVGRLRSDLDNGNNSFQ YKLLGAGAGSTFIIDERTGDIYAIEKLDREERSLYILRAQVIDITTGRAVEPESEFVIKVSDINDNEPKFLDEPYEAIVPEMSPEG TLVIQVTASDADDPSSGNNARLLYSLLQGQPYFSVEPTTGVIRISSKMDRELQDEYWIIQAKDMIGQPGALSGTTSVLIKLSDVN DNKPIFKESLYRLTVSESAPTGTSIGTIMAYDNDIGENAEMDYSIEEDDSQTFDIITNHETQEGIVILKKKVNFEHQNHYGIRAKV KNHHVDEQLMKYHTEASTTFIKIQVEDVDEPPLFLPYYIFEIFEETPQGSFVGVVSATDPDNRKSPIRYSITRSKVFNIDDNGTI TTNSLDREISAWYNLSITATEKYNIEQISSIPVVYQVLNINDHAPEFSQYYESVCENAGSGQVIQTISAVDRDESIEEHHFYFN LSVEDTNNSSFTIIDNQDNTAVILTNRTGFNLQEEPIFYISILIADNGIPSLTSTNTLTIHVCDCDSGSTQTCQYELMLSMGFK TEVIIAILICIMVIFGFIFLTLGLKQRRKQILFPEKSEDFRENIFRYDDEGGGEEDTEAFDVAALRSSTIMRERTRKTTSAEIRS LYRQSLQVGPDSAIFRKFILEKLEEADTDPCAPPFDSLQTYAFEGTGSLAGSLSSLESAVSDQDESYDYLNELGPRFKRLACMFGS AVQSNN |
| 1458 | caCDH19(1-42) ::FLAG::caCDH19 (43-770) | artificial | aa | QFFVPEMNKTDYHIGQLRSDLDNGNNSFQYKLLGAQATENSPEGTLVIQVTATDADDPASGNNARLLYSLLQGQPYFSIEPTTGVIRISSKMDRELQDEY WVIIQAKDMIGLPGALSGTTSVLIKLSDVNDNKPIFKERLYRLTVSESAPTGTSIGRIMAYDNDIGENAEMDYSIEDDSQTFDIIT NNETQEGIVILKKKVDFEHQNHYLIRANVKNRHVAEHLMEYHVEASTTFVRVQVE DEDEPPVFLLPYYLFEILEESPHGSFVGMVS ATDPDQRKSPIRYSITRSKVFSIDDNGTIITTNPLDREISAWYNLSITATEKYNVQQISAVPVYVQVLNINDHAPEFSEYYDSYVC ENAGSGQVIQTISAVDRDESVEDHHFYFNLSVEDSFIIDNEDNTAVILTNRTGFSLQEEPVFYISVLIADNGIPSLTSTNT LTIHICDCDYGSTQTCRDKDLLLSMGFRTLFKGEDFRENIFRYDDEGGGEEDT EAFDIVQLRSSTIMRERKTRKTAAAEIRSLYRQSLQVGPDSAIFRKFILEKLEEANTDPCAPPFDSLQTYAFEGTGSLAGSLSSLG SAVSDQDENYDYLNELGPRFKRLACMFGSAMQSNN |
| 1459 | rhCDH19 (1-43)::FLAG::rhCDH19 (44-141)::caCDH19 (141-770) | artificial | aa | MNCYLLLPFMLGIPLLMPCLGATENSQTKKVQQPVGSHLRVKRDYKDDDDKGWVMQFFVPEEMNTTSHVGRLRSDLDNGNNSFQ YKLLGAGAGSTFIIDERTGDIYAIEKLDREERSLYILRAQVIDITTGRAVEPESEFVIKVSDINDNEPKFLDEPYEAIVPEMSPEG TLVIQVTADDPASGNNARLLYSLLQGQPYFSIEPTTGVIRISSKMDRELQDEYWVIIQAKDMIGLPGALSGTTSVLIKLSDVN DNKPIFKERLYRLTVSESAPTGTSIGRIMAYDNDIGENAEMDYSIEDDSQTFDIIFEHQNHYLIRANVK NRHVAEHLMEYHVEASTTFKVQVEDEDEPPVFLLPYYLFEILEESPHGSFVGMSATDPDQRKSPIRYSITRSKVFSIDDNGTII TTNPLDREISAWYNLSITATEKYNVQQISAVPVYVQVLNINDHAPEFSEYYDSYVCENAGSGQVIQTISAVDRDESVEDHHFYFNL SVEDTNSFFIIDNEDNTAVILTNRTGFSLQEEPVFYISVLIADNGIPSLTSTNTLTIHICDCDYGSTQTCRDKDLLLSMGFRT EVILAILISIMIIFGFIFLLIGLKQRRKPTLFPEKGEDFRENIFRYDEGGGEEDTEAFDIVQLRSSTIMRERKTRKTAAAEIRSL YRQSLQVGPDSAIFRKFILEKLEEANTDPCAPPFDSLQTYAFEGTGSLAGSLSSLGSAVSDQDENYDYLNELGPRFKRLACMFGSA MQSNN |

TABLE VI-continued

| SEQ ID NO. | DESIGNATION | SOURCE | TYPE | SEQUENCE |
|---|---|---|---|---|
| 1460 | rhCDH19 (1-43):: FLAG::rhCDH19 (44-65)::caCDH19 (65-770) | artificial | aa | MNCYLLLPFMLGIPLLWPCLGATENSQTKKVQQPVGSHLRVKRDYDDDKGWVNNQFFVPEEMNITSHHVGRLRSDLDNGNNSFQ YKLLGAGAGSIFVIIDERTGDIYAIQKLDREERSLYTLRAQVIDSTTGRAVEPESEFVIRVSDINDNEPKFLDEPYEAIVPEMSPEG TLVIQVTATDADDPASGNNARLLYSLLQGQPYFSIEPTTGVIRISSKMDRLQDEYWVIIQAKDMIGLPGALSGTTSVLIKLSDVN DNKPIFKERLYRLTVSESAPTGTSIGRIMAYDNDIGENAEMDYSIEDDSQTFDIITNNETQEGIVILKKKVDFEHQNHYLIRANVK NRHVAEHLMEYHVEASTTFVRVQEDEDEPPVFLLPYLFEILEESPHGSFVGMVSATDPDQRKSPIRYSITRSKVFSIDDNGTII TTNPLDREISAWYNLSITATEKYNVQQISAVPVYVQVLNINDHAPEFSEYYDSYVCENAGSGQVIQTISAVDRDESVEDHHFYFNL SVEDTKNSSFIIDNEDNTAVILTNRTGFSLQEEPVFYISVLIADNGIPSLTSTNTLTIHICDDDYGSTQTCRDKDLLLSMGFRT EVILAILISIMIIFGFIFLILGLKQRRKPTLFPEKGEDFRENIFRYDDEGGEEDTEAFDIVQLRSSTIMRERKTRKTAAAEIRSL YRQSLQVGPDSAIFRKFILEKLEEANTDPCAPPFDSLQTYAFEGTGSLAGSLSSLGSAVSDQDENYDYLNELGPRFKRLACMFGSA MQSNN |
| 1461 | caCDH19 (1-43):: FLAG::caCDH19 (44-87)::rhCDH19 (89-114)::caCDH19 (115-770) | artificial | aa | MNYCFLLPLMLGIPLLWPCFTASESSKTEVKHQAGSHLRVKRDYKDDDDKGWMWNQFFVPEMNKTDYHIGQLRSDLDNGNNSFQY KLLGAGAGSTFIIDERTGDIYAIEKLDREERSLYILRAQVIDSTTGRAVEPESEFVIRVSDINDNEPKFLDEPYEAIVPEMSPEGT LVIQVTATDADDPASGNNARLLYSLLQGQPYFSIEPTTGVIRISSKMDRELQDEYWVIIQAKDMIGLPGALSGTTSVLIKLSDVND NKPIFKERLYRLTVSESAPTGTSIGRIMAYDNDIGENAEMDYSIEDDSQTFDIITNNETQEGIVILKKKVDFEHQNHYLIRANVKN RHVAEHLMEYHVEASTTFVRVQEDEDEPPVFLLPYYLFEILEESPHGSFVGMVSATDPDQRKSPIRYSITRSKVFSIDDNGTIIT TNPLDREISAWYNLSITATEKNVQQISAVPVYVQVLNINDHAPEFSEYYDSYVCENAGSGQVIQTISAVDRDESVEDHHFYFNLS VEDTKNSSFIIDNEDNTAVILTNRTGFSLQEEPVFYISVLIADNGIPSLSTNTLTIHICDCDYGSTQTCRDKDLLLSMGFRTE VILAILISIMIIFGFIFLILGLKQRRKPTLFPEKGEDFRENIFRYDDEGGEEDTEAFDIVQLRSSTIMRERKTRKTAAAEIRSLY RQSLQVGPDSAIFRKFILEKLEEANTDPCAPPFDSLQTYAFEGTGSLAGSLSSLGSAVSDQDENYDYLNELGPRFKRLACMFGSAM QSNN |
| 1462 | caCDH19 (1-43):: FLAG::caCDH19 (44-120)::rhCDH19 (122-137)::caCDH19 (137-770) | artificial | aa | MNYCFLLPLMLGIPLLWPCFTASESSKTEVKHQAGSHLRVKRDYKDDDDKGWMWNQFFVPEMNKTDYHIGQLRSDLDNGNNSFQY KLLGAGAGSTFIIDERTGDIYAIEKLDREERSLYILRAQVIDITTGRAVEPESEFVIKVSDINDNEPKFLDEPYEAIVPEMSPEGT LVIQVTATDADDPASGNNARLLYSLLQGQPYFSIEPTTGVIRISSKMDRELQDEYWVIIQAKDMIGLPGALSGTTSVLIKLSDVND NKPIFKERLYRLTVSESAPTGTSIGRIMAYDNDIGENAEMDYSIEDDSQTFDIITNNETQEGIVILKKKVDFEHQNHYLIRANVKN RHVAEHLMEYHVEASTTFVRVQEDEDEPPVFLLPYLFEILEESPHGSFVGMVSATDPDQRKSPIRYSITRSKVFSIDDNGTIIT TNPLDREISAWYNLSITATEKNVQQISAVPVYVQVLNINDHAPEFSEYYDSYVCENAGSGQVIQTISAVDRDESVEDHHFYFNLS VEDTKNSSFIIDNEDNTAVILTNRTGFSLQEEPVFYISVLIADNGIPSLSTNTLTIHICDCDYGSTQTCRDKDLLLSMGFRTE VILAILISIMIIFGFIFLILGLKQRRKPTLFPEKGEDFRENIFRYDDEGGEEDTEAFDIVQLRSSTIMRERKTRKTAAAEIRSLY RQSLQVGPDSAIFRKFILEKLEEANTDPCAPPFDSLQTYAFEGTGSLAGSLSSLGSAVSDQDENYDYLNELGPRFKRLACMFGSAM QSNN |
| 1463 | rhCDH19 (1-43):: FLAG::rhCDH19 (44-141)::raCDH19 (140-247)::rhCDH19 (250-772) | artificial | aa | MNCYLLLPFMLGIPLLWPCLGATENSQTKKVQQPVGSHLRVKRDYDDDKGWVNNQFFVPEEMNTTSHHVGRLRSDLDNGNNSFQ YKLLGAGAGSIFVIIDERTGDIYAIEKLDREERSLYILRAQVIDITTGRAVEPESEFVIKVSDINDNEPRELDEPYEAIVPEMSPEG TFVIKVTANDADDPTSGYHARILYNLEQGQPYFSVEPTTGVIRISSKMDRELQDTYCVIIQAKDMLGQPGALSGTTTISIKLSDIN DNKPIFKESLYRLTVSESAPSGTTIGKIMAYDDDIGENAEMDYSIEDDESQIFPIDVIDNETQEGIVILKKKVDFEHQNHYGIRAKV KNHHVDEQLMKYHTEASTTFIKIQVEDVDEPPLFLLPYYIFEIFEETPQGSFVQYVESYVCENAGSGQVIQTISAVDRDESIEEHHFYFN LSVEDTNSSSFIIDNQDNTAVILTNRTGFNLQEEPIFYISILIADNGIPSLTSTNTLTIHVCCDDSGSTQTCQYQELMLSMGFK TEVIIALICIMVIFGFIFLTLGLKQRRKQLLFPEKSEDFRENIFRYDEGGGEEDTEAFDVAALRSSTIMRERKTRKTTSAEIRS LYRQSLQVGPDSAIFRKFILEKLEEATDDPCAPPFDSLQTYAFEGTGSLAGSLSSLESAVSDQDESYDYLNELGPRFKRLACMFGS AVQSNN |
| 1464 | raCDH19 (1-43):: FLAG::raCDH19 (44-770) | artificial | aa | MNHYFLKYWILMVPLIWPCLKVAETLKIEKAQRAVPSLGRAKRDYKDDDDKGWVWKQFVVPEEMDTIQHVGRLRSDLDNGNNSFQY KLLGTGDGSFSIDEKTGDIFAMQKLDREKQSLYILRAQVIDTTIGKAVEPESEFVIRVSDVNDNEPRFLDEPYEAIVPEMSPEGTF VIKVTANDADDPTSGVHARILYNLEQGQPYFSVEPTTGVIRISSKMDRELQDTYCVIIQAKDMLGQPGALSGTTTISLSDINDN KPIFKESFYRFTISESAPSGTTIGKIMAYDDDIGENAEMDYSIEDDESQIFPDIVIDNETQEGIVILKKKVDFEHQNHYGIRVKVKN CHVDEELAPAHVNASTTYIKVQVEDEDEPPTFLLPYIFEIPEGKPYGTMVGTVSAVDPDRRQSPMRYSLIGSKMPDINGTIVT TNLLDREVSAWYNLSVTATETYNVQQISSAHVVQVLNINDHAPEFSQLYETYVCENAESGEIIQTISAIDRDESIEDHHFYFNHS |

TABLE VI-continued

| SEQ ID NO. | DESIGNATION | SOURCE | TYPE | SEQUENCE |
|---|---|---|---|---|
| | | | | VEDTNNSSFILTDNQDNTAVILSNRAGFSLKEETVFYMIILIADNGIPPLTSTNTLTIQVCDCGDSRSTETCTSKELLFIMGFKAE AIIAIVICVMVIFGPIFLIIALKQRRKETLFPEKTDFRENIFCYDDEGGEEDSEAFDIIELRQSTVMRERKPRKSRSAEIRSLY RQSLQVGPDSAIFRKFILEKLEEANTDSSAPPFDSLQTFAYEGTSSAGSLSSLGSSVTDQEDDFDYLNDLGPCFKRLANMFGSAV QPDN |
| 1465 | (1-43):: FLAG::muCDH19 (44-323):: raCDH19 (324-327):: muCDH19 (328-770) | artificial | aa | MNYCFLKHWIMLMIPLLWPCLKVSETLKAEKARRTVPSTWRAKRDYKDDDDKAWVRPFVVLEEMDDIQCVGKLRSDLDNGNNSFQY KLLGIGAGSFSINERTGEICAIQKLDREEKSLYIIRAQVIDTTIGKAVETESEFVIRVLDINDNEPRFLDEPYEAIVPEMSPEGTF VIKVTANDADDPSTGYHARILYNLERGQPYFSVEPTTGVIRISSKMDRELQDTYCVIIQAKDMLGQPGALSGTTTVSIKLSDINDN KPIFKESFYRFTISESAPIGTSIGKIMAYDDDIGENAEMEYSIEDDDSKIFDIIIDNDTQGIVILKKKVDFEHQNHYGIRAKVKN CHVDEELAPAHVNASTTYIKVQVEDEDEPPVFLLPYYILEIPEGKPYGTIVGTVSATDPDRRQSPMRYYLTGSKMFDINDNGTIIT TNMLDREVSAWNLIVTATETYNVQQISSAHVYVQVFNINDNAPEFSQFYETYVCENAESGEIVQIISAIDRDESIEDHHFYFNHS LEDTNNSSFMLTDNQDNTAVILSNRTGFNLKEEPVFYMILIADNGIPSLTSTNTLTIQVCDCGDSRNTETCANKGLLFIMGFRTE AIIAIMICVMVIFGFFFLIILALKQRRKETLFPEKTEDFRENIFCYDEGGGEEDSEAFDIVELRQSTVMRERKPQRSKSAEIRSLY RQSLQVGPDSAIFRKFILEKLEEANTDPCAPPFDSLQTFAYEGTSSAGSLSSLASRDTDQEDDFDYLNDLGPRFKRLASMFGSAV QPNN |
| 1466 | muCDH19 (1-43):: FLAG::muCDH19 (44-770):: raCDH19 (290, 299, 308) | artificial | aa | MNYCFLKHWIMLMIPLLWPCLKVSETLKAEKARRTVPSTWRAKRDYKDDDDKAWVRPFVVLEEMDDIQCVGKLRSDLDNGNNSFQY KLLGIGAGSFSINERTGEICAIQKLDREEKSLYIIRAQVIDTTIGKAVETESEFVIRVLDINDNEPRFLDEPYEAIVPEMSPEGTF VIKVTANDADDPSTGYHARLLYNLERGQPYFSVEPTTGVIRISSKMDRELQDTYCVIIQAKDMLGQPGALSGTTTVSIKLSDINDN KPIFKESFYRFTISESAPIGTSIGKIMAYDDIGENAEMEYSIEDDDSKIFDIIIDNDTQEGIVILKKKVDFEQQSYYGIRAKVKN CHVDEELAPAHVNASTTYIKVQVEDEDEPPVFLLPYYILEIPEGKPYGTIVGTVSATDPDRRQSPMRYYLTGSKMFDINDNGTIIT TNMLDREVSAWNLIVTATETYNVQQISSAHVYVQVFNINDNAPEFSQFYETYVCENAESGEIVQIISAIDRDESIEDHHFYFNHS LEDTNNSSFMLTDNQDNTAVILSNRTGFNLKEEPVFYMILIADNGIPSLTSTNTLTIQVCDCGDSRNTETCANKGLLFIMGFRTE AIIAIMICVMVIFGFFFLIILALKQRRKETLFPEKTEDFRENIFCYDEGGGEEDSEAFDIVELRQSTVMRERKPQRSKSAEIRSLY RQSLQVGPDSAIFRKFILEKLEEANTDPCAPPFDSLQTFAYEGTSSAGSLSSLASRDTDQEDDFDYLNDLGPRFKRLASMFGSAV QPNN |
| 1467 | muCDH19 (1-43):: FLAG::muCDH19 (44-770):: huCDH19 (271) | artificial | aa | MNYCFLKHWIMLMIPLLWPCLKVSETLKAEKARRTVPSTWRAKRDYKDDDDKAWVRPFVVLEEMDDIQCVGKLRSDLDNGNNSFQY KLLGIGAGSFSINERTGEICAIQKLDREEKSLYIILRAQVIDTTIGKAVETESEFVIRVLDINDNEPRFLDEPYEAIVPEMSPEGTF VIKVTANDADDPSTGYHARLLYNLERGQPYFSVEPTTGVIRISSKMDRELQDTYCVIIDNDTQEGIVILKKKVDFEQQSYYGIRAKVKN KPIFKESFYRFTISESAPTGTSIGKIMAYDDIGENAEMEYSIEDDDSKIFDIIIDNDTQEGIVILKKKVDFEQQSYYGIRAKVKN CHVDEELAPAHVNASTTYIKVQVEDEDEPPVFLLPYYILEIPEGKPYGTIVGTVSATDPDRRQSPMRYYLTGSKMFDINDNGTIIT TNMLDREVSAWNLIVTATETYNVQQISSAHVYVQVFNINDNAPEFSQFYETYVCENAESGEIVQIISAIDRDESIEDHHFYFNHS LEDTNNSSFMLTDNQDNTAVILSNRTGFNLKEEPVFYMILIADNGIPSLTSTNTLTIQVCDCGDSRNTETCANKGLLFIMGFRTE AIIAIMICVMVIFGFFFLIILALKQRRKETLFPEKTEDFRENIFCYDEGGGEEDSEAFDIVELRQSTVMRERKPQRSKSAEIRSLY RQSLQVGPDSAIFRKFILEKLEEANTDPCAPPFDSLQTFAYEGTSSAGSLSSLASRDTDQEDDFDYLNDLGPRFKRLASMFGSAV QPNN |
| 1468 | VH of CDH19 14302 CC x I2C | artificial | nt | CAGGTGCAGTTGGTGGAGTCTGGGGGAGGCGTGGTCCAGCCTGGGGGGTCCCTGAGACTCTCCTGTGCAGCGTCTGGATTCACCTT CAGTAGCTATGGCATGCACTGGGTCCGCCAGGCTCCAGGCAAGGGTCTGGAGTGGGTGGCATTTATATGGTATGATGGAAGTAATA AATACTATGCAGACTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAGAGGGCCGGTATAAATAGGAACTATAGGCTACTACTACGGTATGGACGCTG GGGCCAAGGGACCACCGGTCACCGTCTCTAGT |
| 1469 | VH of CDH19 14302 CC x I2C | artificial | AA | QVQLVESGGGVVQPGGSLRLSCAASGFTFSSYGMHWVRQAPGKCLEMVAFIWYDGSNKYYADSVKDRFTISRDNSKNTLYLQMNSL RAEDTAVYYCARRAGIIGTIGYYYGMDVWGQGTTVTVSS |
| 1470 | VL of CDH19 14302 CC x I2C | artificial | nt | TCCTATGAACTGACTCAGCACCCTCAGTGTCCGTCCCCAGGACAGACAGCCATCATCACCTGCTCCTGAGATAGGTTGGGGA AAAATATACTAGCTGGTATCAGCAGAAGCCAGGCCAGTCCCCTTTGCTGTCCATTTATCAAGATACCAAGCGGCCCTCAGGGATCC CTGAGCGATTCTCTGGCTCCAACTCTGGTAACACAGCCACTCTGACCATCAGCGGACCCAGGCTATGGATGAGGCTGACTATTAC TGTCAGGTGCGGAGCAGCAGCACTGTGTATTCGGCGGCGGAGGGACCAAGCTGACCGTCCTA |

TABLE VI-continued

| SEQ ID NO. | DESIGNATION | SOURCE | TYPE | SEQUENCE |
|---|---|---|---|---|
| 1471 | VL of CDH19 14302 CC x I2C | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |
| 1472 | VH-VL of CDH19 14302 CC x I2C | artificial | nt | CAGGTGCAGTTGGTGGAGTCTGGGGGAGGCGTGGTCCAGCCTGGGAGGTCCCTGAGACTCTCCTGTGCAGCGTCTGGATTCACCTT CAGTAGCTATGGCATGCACTGGGTCCGCCAGGCTCCAGGCAAGTGTCTGGAGTGGGTGGCATTTATATGGTATGATGGAAGTAATA AATACTATGCAGAGACTCCGTGAAGGACCGATTCACCATCTCCAGAGACAATTCCAAGAACACGCTGTATCTGCAAATGAATAGCCTG AGAGCTGAGGACACCGCTGTGTATTACTGTGCGAGAGAGGCCGGTATAATAGGAACTATAGGCTACTACGGTATGGACGTCTG GGGCCAAGGGACCACGGTCACCGTCTCAGTGTCCGGAGGTGGTGGCGGTTCTGGCGGCGGCGGCTCCTCCTATGAAC TGACTCAGCCACCCTCAGTGTCCGTGTCCCAGGACAGCAGTCCCCTTTGCTGTCATTATCAGCGGACCATCAGCGATCCTGAGCGATT AGTCTGTATCGACAGAGGCCAGGCCAGTCCCCCACTCTGACCATCTATCAAGATACCAAGCGGCCTCAGGATCCTGAGCGATT CTCTGGCTCCAACTCTGGTATTCGCCTGCGGGACCCAGGCTATGGATGAGGCTGACTATTACTGTCAGGCGT GGGAGAGCAGCACTGTGTATTCGCCTGGGGACCAAGCTGACCGTCCTA |
| 1473 | VH-VL of CDH19 14302 CC x I2C | artificial | AA | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVL |
| 1474 | CDH19 14302 CC x I2C | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVL |
| 1475 | CDH19 14302 x F12q0 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLSGGGGSEVQLVE SGGGLVQPGGSLRLSCAASGFTFNSYAMNWVRQAPGKGLEWVARIRSKYNNYATYYADSVKGRFTISRDDSKNTAYLQMNSLKTED TAVYYCVRHGNFGNSVSVSWWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVL |
| 1476 | CDH19 14302 CC x F12q0 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLRLSCAASGFTFNSYAMNWVRQAPGKGLEWVARIRSKYNNYATYYADSVKGRFTISRDDSKNTAYLQMNSLKTED TAVYYCVRHGNFGNSVSVSWWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVL |
| 1477 | VH of CDH19 21-14302 x I2C | artificial | nt | CGGCTGATCGAGGACATCTGCCTGCCCAGATGGGGACTGCTGTGGAGGACGACCAGGTGCAGTTGGTGGAGTCTGGGGGAGGCGT GGTCCAGCCTGGGGGGTCCCTGAGACTCTCCTGTGCAGCGTCTGGATTCACCTTCAGTAGCTATGGCATGCACTGGGTCCGCCAGG CTCCAGGCAAGGGACTGGAGTGGGTGGCATTTATATGGTATGATGGAAGTAATAAATACTATGCAGACTCCGTGAAGGACCGATTC ACCATCTCCAGAGACAATTCCAAGAACACGCTGTATCTGCAAATGAATAGCCTGAGAGCTGAGGACACCGCTGTGTATTACTGTGC GAGAAGGGCCGGTATAATAGGAACTATAGGCTACTACGGTATGGACGTCTGGGGCCAAGGGACCACGGTCACCGTCTCTAGT |
| 1478 | VH of CDH19 21-14302 x I2C | artificial | AA | RLIEDICLPRWGCLWDDQVQLVESGGGVVQPGGSLRLSCAASGFTFSSYGMHWVRQAPGKGLEWVAFIWYDGSNKYYADSVKDRF TISRDNSKNTLYLQMNSLRAEDTAVYYCARRAGIIGTIGYYYGMDVWGQGTTVTVSS |

TABLE VI-continued

| SEQ ID NO. | DESIGNATION | SOURCE | TYPE | SEQUENCE |
|---|---|---|---|---|
| 1479 | VL of CDH19 21-14302 x I2C | artificial | nt | TCCTATGAACTGACTCAGCCACCCTCAGTGTCCGTGTCCCCAGGACAGACAGCCAGCATCACCTGCTCTGGAGATAGGTTGGGGA AAAATATACTGGTATCAGCAGAAGCCAGGCCAGTCCCTTGTCATTATCAAGATACCAAGCGGCCCTCAGGGATCC CTGAGCGATTCTCTGCTCCAACTCTGGTAACACGCCATCAGCGACCCAGCCTATGGATGAGGCTGACTATTAC TGTCAGCGTGGGAGAGCACACTGTGTATTCGGCGGAGGGACCAAGCTGACCGTCCTA |
| 1480 | VL of CDH19 21-14302 x I2C | artificial | AA | SYELTQPPSVSVSPGQTASITCSGDRLGEKYTSWYQQRPGQSPLLVIYQDTKRPSGIPERFSGSNGNTATLTISGTQAMDEADYY CQAWESSTVVFGGGTKLTVL |
| 1481 | VH-VL of CDH19 21-14302 x I2C | artificial | nt | CGGCTGATCGAGGACATCTGCCTGCCCAGATGGGGCTGCCTGGAGGACGACCAGGTGCAGTTGGTGGAGTCTGGGGGAGGCGT GGTCCAGCCTGGGGGGTCCCTGAGACTCTCCTGTGCAGCTCTGGATTCACCTTCAGTAGCTATGGCATGCACTGGGTCCGCCAGG CTCCAGGCAAGGGCTGGAGTGGGTGGCATTTATATGGTATGATGGAAGTAATAAATACTATGCAGACTCCGTGAAGGACCGATTC ACCATCTCCAGAGACAATTCCAAGAACACGCTGTATCTGCAAATGAATAGCCTGAGAGCTGAGGACACGGCTGTGTATTACTGTGC GAGAGGGCCGTATAATAGGAGCGGATATGAAGCTATCAGCGCGGATCTTCCTATGACGTCTGGGGCCAAGGGACCACCTCAGCGT CCTCCAGTGTCCGTGTCCCCA GGACAGACAGCCAGCATCTCCTATGAACTGACTCAGCCACCCTCAGTGTCTGTAACAGCACTC GACAGACAGCAGCATCACCTGCTCTGGAGATAGGTTGGGGAAAAATATACTAGCTGGTATCAGCAGAGGCCAGCCAGTCCCC TTTGCTCATCATCAGCGGACCCAGGCTGGATGAGGCTGACTATTACTGTCAGGCGTGGGAGAGCAGCAGTCTGGTATTCGGCGGAGGG ACCAAGCTGACCGTCCTA |
| 1482 | VH-VL of CDH19 21-14302 x I2C | artificial | AA | RLIEDICLPRWGCLWEDDQVQLVESGGGVVQPGGSLRLSCAASGFTFSSYGMHWVRQAPGKGLEWVAFIWYDGSNKYYADSVKDRF TISRDNSKNTLYLQMNSLRAEDTAVYYCARRAGIIGTIGYYYGMDVWGQGTTVTVSSGGGGSGGGGSGGGGSSYELTQPPSVSVSP GQTASITCSGDRLGEKYTSWYQQRPGQSPLLVIYQDTKRPSGIPERFSGSNGNTATLTISGTQAMDEADYYCQAWESSTVVFGGG TKLTVL |
| 1483 | CDH19 21-14302 x I2C | artificial | aa | RLIEDICLPRWGCLWEDDQVQLVESGGGVVQPGGSLRLSCAASGFTFSSYGMHWVRQAPGKGLEWVAFIWYDGSNKYYADSVKDRF TISRDNSKNTLYLQMNSLRAEDTAVYYCARRAGIIGTIGYYYGMDVWGQGTTVTVSSGGGGSGGGGSGGGGSGGGGSTVVPGGGTVTL GQTASITCSGDRLGEKYTSWYQQRPGQSPLLVIYQDTKRPSGIPERFSGSNGNTATLTISGTQAMDEADYYCQAWESSTVVFGGGG TKLTVLSGGGGSEVQLVESGGGLVQPGGSLKLSCAASGFTPNKYAMNWVRQAPGKGLEWVARIRSKYNNYATYYADSVKDRFTISR DDSKNTAYLQMNNLKTEDTAVYYCVRHGNEGNSYISYWAYWGQGTLVTVSSGGGGSGGGGSGGGGSGGGGSQVTVQEPSLTVSPGGTVTL TCGSSTGAVTSGNYPNWVQQKPGQAPRGLIGTKFLAPGTPARFSGSLLGKAALTLSGVQPEDEAEYYCVLWYSNRWVFGGGTKL TVLHHHHHH |
| 1484 | VH of CDH19 21-14302 CC x I2C | artificial | nt | CGGCTGATCGAGGACATCTGCCTGCCCAGATGGGGCTGCCTGGAGGACGACCAGGTGCAGTTGGTGGAGTCTGGGGGAGGCGT GGTCCAGCCTGGGGGGTCCCTGAGACTCTCCTGTGCAGCTCTGGATTCACCTTCAGTAGCTATGGCATGCACTGGGTCCGCCAGG CTCCAGGCAAGGGCTGGAGTGGGTGGCATTTATATGGTATGATGGAAGTAATAAATACTATGCAGACTCCGTGAAGGACCGATTC ACCATCTCCAGAGACAATTCCAAGAACACGCTGTATCTGCAAATGAATAGCCTGAGAGCTGAGGACACGGCTGTGTATTACTGTGC GAGAAGGGCCCGTATAATAGGAACTATAGGCTACTACTACGGTATGGACGTCTGGGGCCAAGGGACCACGGTCACCGTCTCTAGT |
| 1485 | VH of CDH19 21-14302 CC x I2C | artificial | AA | RLIEDICLPRWGCLWEDDQVQLVESGGGVVQPGGSLRLSCAASGFTFSSYGMHWVRQAPGKGLEWVAFIWYDGSNKYYADSVKDRF TISRDNSKNTLYLQMNSLRAEDTAVYYCARRAGIIGTIGYYYGMDVWGQGTTVTVSS |
| 1486 | VL of CDH19 21-14302 CC x I2C | artificial | nt | TCCTATGAACTGACTCAGCCACCCTCAGTGTCCGTGTCCCCAGGACAGACAGCCAGCATCACCTGCTCTGGAGATAGGTTGGGGA AAAATATACTGGTATCAGCAGAAGCCAGGCCAGTCCCTTGTCATTATCAAGATACCAAGCGGCCCTCAGGGATCC CTGAGCGATTCTCTGCTCCAACTCTGGTAACACGCCATCAGCGGGACCCAGGCTATGGATGAGGCTGACTATTAC TGTCAGCGTGGGTGGAGCAGCAGTCTGGTATTCGGCGGAGGGACCAAGCTGACCGTCCTA |

TABLE VI-continued

| SEQ ID NO. | DESIGNATION | SOURCE | TYPE | SEQUENCE |
|---|---|---|---|---|
| 1487 | VL of CDH19 21-14302 CC x I2C | artificial | AA | SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL |
| 1488 | VH-VL of CDH19 21-14302 CC x I2C | artificial | nt | CGGCTGATCGAGGACATCTGCCTGCCCAGATGGGGCTGCCTGTGGAGGACGACCAGGTGCAGTTGGTGGAGTCTGGGGGAGGCGTGGTCCAGCCTGGGGGGTCCCTGAGACTCTCCTGTGCAGCCTCTGGATTCACCTTCAGTAGCTATAGCATGCACTGGGTCCGCCAGGCTCCAGGCAAGGTCTGGAGTGGGTGGCATTTATATGGTATGATGGAAGTAATAAATACTATGCAGACTCCGTGAAGGACCGATTCACCATCTCCAGAGACAATTCCAAGAACACGCTGTATCTGCAAATGAACAGCCTGAGAGCTGAGGACACGGCTGTGTATTACTGTGCGAGAAGGGCCGGTATAATAGGAACTATAGGCTACTACTACGGTATGGACGTCTGGGGCCAAGGGACCACGGTCACCGTCTCAGTGGAGGCCGAGGATCTGGTGCCGTGGTTCTGCGAGATAGGTTGGGGAGAAAATATACTGGTATCAGCAGAGGCCAGGTCCCAGACAGACAGCCAGATCACCTGCTCTGGAGATAGGTTGGGGAGAAAATATACTGGTATCAGCAGAGGCCAGGTCCCTTTGCTGGTCATCTATCAAGATACCAAGCGGCCCTCAGGGATCCCTGAGCGATTCTCTGGCTCCAACTCTGGTAACACAGCCACTCTGACCATCAGCGGGACCCAGGCTATGGATGAGGCTGACTATTACTGTCAGGCGTGGGACAGCACTGTGTATTCGGCTGCGGGACCAAGCTGACCGTCCTA |
| 1489 | VH-VL of CDH19 21-14302 CC x I2C | artificial | AA | RLIEDICLPRWGCLWEDDQVLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL |
| 1490 | CDH19 21-14302 CC x I2C | artificial | aa | RLIEDICLPRWGCLWEDDQVLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNLKTEDTAVYYCVRHGNFGNSYISYWAYWGQGTLVTVSSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1491 | CDH19 14302 x I2C | artificial | aa | QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNLKTEDTAVYYCVRHGNFGNSYISYWAYWGQGTLVTVSSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH |
| 1492 | CDH19 14302 CC x I2C-21 | artificial | aa | QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNLKTEDTAVYYCVRHGNFGNSYISYWAYWGQGTLVTVSSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH |
| 1493 | VH of CDH19 14302 x I2C x FcBy | artificial | nt | CAACGTTTCTGTACCGTCACTTCGTCGTCTGCTGTTCGCAGGTGCAGTTGGTGGAGTCTGGGGGAGGCGTGGTCCAGCCTGGGGGGTCCCTGAGACTCTCCTGTGCAGCCTCCGGATTCACCTTCAGTAGCTATGGCATGCACTGGGTCCGCCAGGCTCCAGGCAAGGGGCTGGAGTGGGTGGCATTTATATGGTATGATGGAAGTAATAAATACTATGCAGACTCCGTGAAGGACCGATTCACCATCTCCAGAGACAATTCCAAGAACACGCTGTATCTGCAAATGAACAGCCTGAGAGCTGAGGACACGGCTGTGTATTACTGTGCGAGAAGGGCCGGTATAATAGGAACTATAGGCTACTACTACGGTATGGACGTCTGGGGCCAAGGGACCACGGTCACCGTCTCTAGT |

TABLE VI-continued

| SEQ ID NO. | DESIGNATION | SOURCE | TYPE | SEQUENCE |
|---|---|---|---|---|
| 1494 | VH of CDH19 14302 x I2C x FcBγ | artificial | AA | QRFCTGHFGGLYPCNGGGGSQVQLVESGGGVVQPGGSLRLSCAASGFTFSSYGMHWVRQAPGKGLEWVAFIWYDGSNKYYADSVK DRFTISRDNSKNTLYLQMNSLRAEDTAVYYCARRAGIIGTIGYYYGMDVWGQGTTVTVSS |
| 1495 | VL of CDH19 14302 x I2C x FcBγ | artificial | nt | TCCTATGAACTGACTCAGCCACCCTCAGTGTCTGTGTCCCCAGGACAGACAGCCATCACCTGCTCTGGAGATAGGTTGGGGGA AAATATACTAGCTGGTATCAGCAGAGGCCAGGCCAGTCCCCTTTGCTGGTCATTATCAAGATACCAAGCGGCCCTCAGGGATCC CTGAGCGATTCTCTGGCTCCAACTCTGGTAACACAGCCTCTCTGACCATCAGCGGGACCCAGGCTATGGATGAGGCTGACTATTAC TGTCAGGCGTGGGAGAGCAGCACTGTGGTATTCGGCGGAGGGACCAAGCTGACCGTCCTA |
| 1496 | VL of CDH19 14302 x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGGGTKLTVL |
| 1497 | VH-VL of CDH19 14302 x I2C x FcBγ | artificial | nt | CAACGTTTCTGTACCGGTCACTTCGGTGGTCTGTACCCGTGTAATGGTGGTGGTGGTTCGCAGGTGCAGTTGGTGGAGTCTGG GGGAGGCGTGGTCCAGCCTGGGGGGTCCCTGAGACTCTCCTGTGCAGCGTCTGGATTCACCTTCAGTAGCTATGGCATGCATTGG GTCCGCCAGGCTCCAGGCAAGGGGCTGGAGTGGGTGGCATTTATATATGGTATGATGGAAGTAATAAATACTATGCAGATTCCGTGAAG GACCGATTCACCATCTCCAGAGACAATTCCAAGAACACGCTGTATCTGCAAATGAATAGCCTGAGAGCTGAGGACACGGCTGTGTA TTACTGTGCGAGAAGGGCCGGTATAGGCTACTACGGATACTTCCTATGAACTGACTCAGCCACCCTCAGTGTCC GTGTCCCCAGGACAGACAGCCATCACCTGCTCTGGAGATAGGTTGGGGGAAAATATACTAGCTGGTATCAGCAGAGGCCAGG CCAGTCCCCTTTGCTGGTCATTATCAAGATACCAAGCGGCCCTCAGGGATCCCTGAGCGATTCTCTGGCTCCAACTCTGGTAACA CAGCCACTCTGACCATCAGCGGGACCCAGGCTATGGATGAGGCTGACTATTACTGTCAGGCGTGGGAGAGCAGCACTGTGGTATTC GGCGGAGGGACCAAGCTGACCGTCCTA |
| 1498 | VH-VL of CDH19 14302 x I2C x FcBγ | artificial | AA | QRFCTGHFGGLYPCNGGGGSQVQLVESGGGVVQPGGSLRLSCAASGFTFSSYGMHWVRQAPGKGLEWVAFIWYDGSNKYYADSVK DRFTISRDNSKNTLYLQMNSLRAEDTAVYYCARRAGIIGTIGYYYGMDVWGQGTTVTVSSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GGGTKLTVL |
| 1499 | CDH19 14302 x I2C x FcBγ | artificial | aa | QRFCTGHFGGLYPCNGGGGSQVQLVESGGGVVQPGGSLRLSCAASGFTFSSYGMHWVRQAPGKGLEWVAFIWYDGSNKYYADSVK DRFTISRDNSKNTLYLQMNSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQAPRGLIGGTKFLAPGTPARFSGSLLGGKAALTLSGVQPEDEAEYYCVLWYSNRWVFGGG TKLTVLGGGGSQRFCTGHFGGLHPCNGHHHHHH |
| 1500 | VH of CDH19 14302 CC x I2C x FcBγ | artificial | nt | CAACGTTTCTGTACCGGTCACTTCGGTGGTCTGTACCCGTGTAATGGTGGTGGTGGTTCGCAGGTGCAGTTGGTGGAGTCTGG GGGAGGCGTGGTCCAGCCTGGGGGGTCCCTGAGACTCTCCTGTGCAGCGTCTGGATTCACCTTCAGTAGCTATGGCATGCACTGG GTCCGCCAGGCTCCAGGCAAGTGTCTGGAGTGGGTGGCATTTATATGGTATGATGGAAGTAATAAATACTATGCAGATTCCGTGAAG GACCGATTCACCATCTCCAGAGACAATTCCAAGAACACTCTATCTGCAAATGAATAGCCTGAGAGCTGAGGACACGGCTGTGTA TTACTGTGCGAGAAGGGCCGGTATAATAGGACTATATGGACGTCTGGGGCCAAGGGACCACGGTCACCG TCTCTAGT |
| 1501 | VH of CDH19 14302 CC x I2C x FcBγ | artificial | AA | QRFCTGHFGGLYPCNGGGGSQVQLVESGGGVVQPGGSLRLSCAASGFTFSSYGMHWVRQAPGKCLEWVAFIWYDGSNKYYADSVK DRFTISRDNSKNTLYLQMNSLRAEDTAVYYCARRAGIIGTIGYYYGMDVWGQGTTVTVSS |

TABLE VI-continued

| SEQ ID NO. | DESIGNATION | SOURCE | TYPE | SEQUENCE |
|---|---|---|---|---|
| 1502 | VL of CDH19 14302 CC x I2C x FcBγ | artificial | nt | TCCTATGAACTGACTCAGCCACCCTCAGTGTCCGTGTCCCCAGGACAGAGCCAGCCATCACCTGCTCTGGAGATAGGTTGGGGGA AAAATATACTGCTGGTACCAGCAGAAGCCAGGCCAGTCCCCCTTGCTGGTCATTTATCAAGATACCAAGCGGCCCTCAGGGATCC CTGAGCGATTCTCTGGCTCCAACTCTGGTAACACAGCCACTCTGACCATCAGCGGACCCAGGCTATGGATGAGGCTGACTATTAC TGTCAGGCTGGGAGAGCACACTGTGTATTCGGCGGAGGGACCAAGCTGACCGTCCTA |
| 1503 | VL of CDH19 14302 CC x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |
| 1504 | VH-VL of CDH19 14302 CC x I2C x FcBγ | artificial | nt | CAACGTTTCTGTACCGTCACTTCGGTGGTCTGTACCCGTGTAATGGTGTGTGGTGTCGCAGGTGCAGTTGGTGGAGTCTGG GGGAGGCGTGGTCCAGCCTGGGGGGTCCCTGAGACTCTCTGCGCTGCGACTCTTCAGTAGCTATGGCATGCATGGG TCCGCCAGGCAAGTTCTGGATGGGCTATGGATGATGTGGAAGTAATAAATATATGAAGATTCCGTGAAG GACCGATTCACCATCTCCAGAGACAATTCCAAGAACACGCTGTATCTGCAAATGAATAGCCTGAGAGCTGAGGACACGGCTGTGTA TTACTGTGCGAGAAGGCCGGAGGATCGGTTGGCGGTGTTCTGGACAGGCCCTGTGGTAGCACCTATGAACTACATCAGCGTCC GTGTCCCCAGGACAGAGCCAGCCATCACCTGCTCTGGAGATAGGTTGGGGGAAAAATATACTGCTGGTACCAGCAGAAGCCAGG CCAGTCCCCTTTGCTGGTCATTTATCAGGACCCAGCTATGGATGAGGCTGACTATTACTGTCAGGCTGGGAGAGCACACTGTGTA CAGCCACTCTGACCATCAGCGGACCCAGGCTATGGATGAGGCTGACTATTACTGTCAGGCTGGGAGAGCACACTGTGGTAACA GGCTGCGGGACCAAGCTGACCGTCCTA |
| 1505 | VH-VL of CDH19 14302 CC x I2C x FcBγ | artificial | AA | QRFCTGHFGGLYPCNGGGGSQVQLVESGGGVVQPGGSLRLSCAASGFTFSSYGMHWVRQAPGKCLEWVAFIWYDGSNKYYADSVK DRFTISRDNSKNTLYLQMNSLRAEDTAVYYCARRAGIIGTIGYYYGMDVWGQGTTVTVSSGGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVL |
| 1506 | CDH19 14302 CC x I2C x FcBγ | artificial | aa | QRFCTGHFGGLYPCNGGGGSQVQLVESGGGVVQPGGSLRLSCAASGFTFSSYGMHWVRQAPGKCLEWVAFIWYDGSNKYYADSVK DRFTISRDNSKNTLYLQMNSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISWAYWGQGTLVTVSSGGGGSGGGGSGGGGSQTVVTQEPSLTVSPGGT VTLTCGSSTGAVTSGNYPNWVQQKPGQAPRGLIGTKFLAPGTPARFSGSLLGGKAALTLSGVQPEDEAEYYCVLWYSNRWVFGGG TKLTVLGGGGSQRFCTGHFGGLHPCNGHHHHHH |
| 1507 | VH of CDH19 14303 CC x I2C x FcBγ | artificial | nt | CAGGTGCAGTTGGTGGAGTCTGGGGGAGGCGTGGTCCAGCCTGGGGGGTCCCTGAGACTCTCCTGTGCAGCCTCTGGATTCACCTT CAGTAGCTATGGCATGCACTGGGTCCGCCAGGCTCCAGGCAAGGGGCTGGAGTGGGTGGCATTTATATGGTATGAGGAAGTAATA AATACTATGCAGAGTCCGTGAAGGGCCGATTCACCATCTCCAGAGACAATTCCAAGAACACGCTGTATCTGCAAATGAAAAGCCTG AGAGCTGAGGACACGGCTGTGTATTACTGTGCGAGAGGGCCGGTATAATAGGAACTATAGGCTACTACTACGGTATGGACGTCTG GGGCCAAGGGACCACGGTCACCGTCTCTAGT |
| 1508 | VH of CDH19 14303 CC x I2C x FcBγ | artificial | AA | QVQLVESGGGVVQPGGSLRLSCAASGFTFSSYGMHWVRQAPGKGLEWVAFIWYEGSNKYYAESVKDRFTISRDNSKNTLYLQMKSL RAEDTAVYYCARRAGIIGTIGYYYGMDVWGQGTTVTVSS |
| 1509 | VL of CDH19 14303 CC x I2C x FcBγ | artificial | nt | TCCTATGAACTGACTCAGCCACCCTCAGTGTCCGTGTCCCCAGGACAGAGCCAGCCATCACCTGCTCTGGAGATAGGTTGGGGGA AAAATATACTGCTGGTACCAGCAGAAGCCAGGCCAGTCCCCTTTGCTGGTCATTTATCAAGATACCAAGCGGCCCTCAGGGATCC CTGAGCGATTCTCTGGCTCCAACTCTGGTAACACAGCCACTCTGACCATCAGCGGACCCAGGCTATGGATGAGGCTGACTATTAC TGTCAGGCTGGGAGAGCAGCACTGTGTATTCGGCGGAGGGACCAAGCTGACCGTCCTA |
| 1510 | VL of CDH19 14303 CC x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |

TABLE VI-continued

| SEQ ID NO. | DESIGNATION | SOURCE | TYPE | SEQUENCE |
|---|---|---|---|---|
| 1511 | VH-VL of CDH19 14303 CC x I2C | artificial | nt | CAGGTGCAGTTGGTGGAGTCTGGGGGAGGCGTGGTCCAGCCTGGGAGGTCCCTGAGACTCTCCTGTGCAGCGTCTGGATTCACCTT CAGTAGCTATGGCATGCACTGGGTCCGCCAGGCTCCAGGCAAGGGCTGGAGTGGGTGGCATTTATATGGTATGAGGGAAGTAATA AATACTATGCAGAGTCCGTGAAGGACCGATTCACCATCTCCAGAGACAATTCCAAGAACACGCTGTATCTGCAAATGAACAGCCTG AGAGCTGAGGACACGGCTGTGTATTACTGCGTGAAGACGGCCGTGTATAATAGGAACTATAGGCTTACTACTACGGTATGACGTCTG GGGCCAAGGGACCACCGTCACCGTCTCAGTGGAGGTGGAGGCGGATCGGATCGCAGCAGAGAGATCTCAGGTCAGCTCCGGCGGCGGAGGCTCCTATGAAC TGACTCAGCCACTCCAGTGCTCCGTCCCAGGACAGACAGGCCAGTCCCCTTTGCTCATCTATCAAGATACCAAGCGGCCCTCAGGGATCCTGAGCGATT AGCTGGTATCAGCAGAGGCCAGGCCAGCCACTCTGGTAACACTCCGACCATCAGCGGGACCCAGCTATGGATGAGGCTGACTATTACTGTCAGGCGT CTCTGGCTCCAACTCTGGTAACACTCCGACCATCAGCGGGACCCAGCTATGGATGAGGCTGACTATTACTGTCAGGCGT GGGAGAGCAGCACTGTGTATTCGGCGGAGGGACCAAGCTGACCGTCCTA |
| 1512 | VH-VL of CDH19 14303 CC x I2C | artificial | AA | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGCGTKLTVL |
| 1513 | CDH19 14303 CC x I2C | artificial | aa | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGGGTKLTVLSGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLMYSNRWVFGGGTKLTVL |
| 1514 | CDH19 14303 x F12q0 | artificial | aa | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGGGTKLTVLSGGGSEVQLVE SGGGLVQPGGSLRLSCAASGFTFNSYAMNWVRQAPGKGLEWVARIRSKYNNYATYYADSVKGRFTISRDDSKNTAYLQMNSLKTED TAVYYCVRHGNFGNSVSWWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLMYSNRWVFGGGTKLTVL |
| 1515 | CDH19 14303 CC x F12q0 | artificial | aa | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGGGTKLTVLSGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLMYSNRWVFGGGTKLTVL |
| 1516 | CDH19 14303 x I2C-21 | artificial | aa | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGGGTKLTVLSGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLMYSNRWVFGGGTKLTVLRLIEDICLPRWGCLW EDDHHHHHH |
| 1517 | CDH19 14303 CC x I2C-21 | artificial | aa | QVQLVESGGGVVQPGRSLRLSCAASGFTFSSYGMHWVRQAPGKCLEWVAFIWYEGSNKYYAESVKDRFTISRDNSKNTLYLQMKSL RAEDTAVYYCARRAGIIGTIGYYYGMDVWGQGTTVTVSSGGGGSGGGGSGGGGSYELTQPPSVSVSPGQTASITCSGDRLGEKYT SWYQQRPGQSPLLVIYQDTKRPSGIPERFSGSNGNTATLTISGTQAMDEADYYCQAWESSTVVFGGGTKLTVLSGGGSEVQLVE SGGGLVQPGGSLKLSCAASGETFNKYAMNWVRQAPGKGLEWVARIRSKYNNYATYYADSVKDRFTISRDDSKNTAYLQMNNLKTED TAVYYCVRHGNFGNSYISYNAYWGQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLMYSNRWVFGGGTKLTVLRLIEDICLPRWGCLW EDDHHHHHH |

TABLE VI-continued

| SEQ ID NO. | DESIGNATION | SOURCE | TYPE | SEQUENCE |
|---|---|---|---|---|
| 1518 | VH of CDH19 14303 x I2C x FcBγ | artificial | nt | CAACGTTTCTGTACCGTCACTTCGGTGGTCTGTACCGTGGTTGGTGGTTCGCAGTGCAGTTGGTGGAGTCTGG GGGAGGCGTGGTCCAGCCTGGAGGGTCCCTGAGACTCTCCTGTGCAGCCTCTGGATTCACCTTCAGTAGCTATGGCATGCACTGGG TCCGCCAGGCTCCAGGCAAGGGGCTGGAGTGGGTGGCAGTTATATGGTATGAGGGAAGTAATAAATACTATGCAGAGTCCGTGAAG GACCGATTCACCATCTCCAGAGACAATTCCAAGAACACGCTGTATCTGCAAATGAACAGCCTGAGAGCTGAGGACACGGCTGTGTA TTACTGTGCGAGAAGGGCCCGTATAATAGGAACTACTATAGGCTACTACTACTACTATGGACGTCCAAGGGACCACGGTCACCG TCTCTAGT |
| 1519 | VH of CDH19 14303 x I2C x FcBγ | artificial | AA | QRFCTGHEGGLYPCNGGGGSQVQLVESGGGVVQPGRSLRLSCAASGFTFSSYGMHWVRQAPGKGLEWVAFIWYEGSNKYYAESVK DRFTISRDNSKNTLYLQMKSLRAEDTAVYYCARRAGIIGTIGYYYGMDVWGQGTTVTVSS |
| 1520 | VL of CDH19 14303 x I2C x FcBγ | artificial | nt | TCCTATGAACTGACTCAGCCACCCTCAGTGTCCGTGTCCCCAGGACAGACAGCCAGCATCACCTGCTCTGAGATAGGTTCGGGGA AAATATACTACTGGTATCAGCAGAAGCCAGGCCAGTCCCCTGTACTTATCATCTATCAAGATACCAAGCGGCCCTCAGGGATCC CTGAGCCGATTCTCTGGCTCCAACTCTGGGAACACAGCCACTCTGACCATCAGCGGACCCAGGCTATGGATGAGGCTGACTATTAC TGTCAGGCGTGGGACAGCAGCACTGTGGTATTCGGCGGAGGGACCAAGCTGACCGTCCTA |
| 1521 | VL of CDH19 14303 x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVFGGGTKLTVL |
| 1522 | VH-VL of CDH19 14303 x I2C x FcBγ | artificial | nt | CAACGTTTCTGTACCGTCACTTCGGTGGTCTGTACCGTGGTTGGTGGTTCGCAGTGCAGTTGGTGGAGTCTGG GGGAGGCGTGGTCCAGCCTGGAGGGTCCCTGAGACTCTCCTGTGCAGCCTCTGGATTCACCTTCAGTAGCTATGGCATGCACTGGG TCCGCCAGGCTCCAGGCAAGGGGCTGGAGTGGGTGGCAGTTATATGGTATGAGGGAAGTAATAAATACTATGCAGAGTCCGTGAAG GACCGATTCACCATCTCCAGAGACAATTCCAAGAACACGCTGTATCTGCAAATGAACAGCCTGAGAGCTGAGGACACGGCTGTGTA TTACTGTGCGAGAAGGGCCCGTATAATAGGAACTACTATAGGCTACTACTACTACTATGGACGTCCAAGGGACCACGGTCAGTGTC GTGTCCCCAGGACAGACAGCCAGCATCATCATCAAGATACCAAGCGGCCCTCAGGGATCCCCTGAGCCGATTCTCTGGCTCCAACTCTGTAACA CAGTCCCCTTTGCTGACCATCAGCGGACCCAGGCTGACTATTACTGTCAGGCGTGGGACAGCAGCACTGTGGTATTC GGCGGAGGGACCAAGCTGACCGTCCTA |
| 1523 | VH-VL of CDH19 14303 x I2C x FcBγ | artificial | AA | QRFCTGHFGGLYPCNGGGGSQVQLVESGGGVVQPGRSLRLSCAASGFTFSSYGMHWVRQAPGKGLEWVAFIWYEGSNKYYAESVK DRFTISRDNSKNTLYLQMKSLRAEDTAVYYCARRAGIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GGGTKLTVL |
| 1524 | CDH19 14303 x I2C x FcBγ | artificial | aa | QRFCTGHFGGLYPCNGGGGSQVQLVESGGGVVQPGRSLRLSCAASGFTFSSYGMHWVRQAPGKGLEWVAFIWYEGSNKYYAESVK DRFTISRDNSKNTLYLQMKSLRAEDTAVYYCARRAGIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GGGTKLTVLSGGGGSEVQLVESGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISWAYWGQGTLVTVSSGGGGSGGGGSGGGGSQTVVTQEPSLTVSPGGT VTLTCGSSTGAVTSGNYPNWVQQKPGQAPRGLIGGTKFLAPGTPARFSGSLLGKAALTLSGVQPEDEAEYYCVLWYSNRWVFGGG TKLTVLGGGGSGQRFCTGHFGGLHPCNGHHHHHH |
| 1525 | VH of CDH19 14303 CC x I2C x FcBγ | artificial | nt | CAACGTTTCTGTACCGTCACTTCGGTGCTGTACCGTGGTAATGGTGGTGGTTCGCAGTGCAGTTGGTGGAGTCTGG GGGAGGCGTGGTCCAGCCTGGAGGGTCCCTGAGACTCTCCTGTGCAGCCTCTGGATTCACCTTCAGTAGCTATGGCATGCACTGGG TCCGCCAGGCTCCAGGCAAGGGGCTCGAGTGGGTGGCAGTTATATGGTATGAGGGAAGTAATAAATACTATGCAGAGTCCGTGAAG GACCGATTCACCATCTCCAGAGACAATTCCAAGACACGCTGTATCTGCAAATGAACGTATGACTGCTGAGAGCTGAGGACACGGCTGTGTA TTACTGTGCGAGAAGGGCCCGTATAATAGGAACTATAGCTACTACTACTACTATGGACGTCTGGGCCAAGGGACCACGGTCACCG TCTCTAGT |

TABLE VI-continued

| SEQ ID NO. | DESIGNATION | SOURCE | TYPE | SEQUENCE |
|---|---|---|---|---|
| 1526 | VH of CDH19 14303 CC x I2C x FcBγ | artificial | AA | QRFCTGHFGGLYPCNGGGGSQVQLVESGGGVVQPGRSLRLSCAASGFTFSSYGMHWVRQAPGKCLEWVAPIWYEGSNKYYAESVK DRFTISRDNSKNTLYLQMKSLRAEDTAVYYCARRAGIIGTIGYYYGMDVWGQGTTVTVSS |
| 1527 | VL of CDH19 14303 CC x I2C x FcBγ | artificial | nt | TCCTATGAACTGACTCAGCCACCCTCAGTGTCCGTGTCCCAGGACAGACAGCATCACCTGCTCTGGAGATAGGTTGGGGA AAATATACTAGCTGTATACAGAGGCCAGTGGGACAGAGCCAGGCTCATCTATCAAGATACCAAGCGGCCCTCAGGGATCC CTGAGCGATTCTCTGGCTCCAACTCTGGTAACACAGCCACTCTGACCATCAGCGGACCCAGGCTATGGATGAGGCTGACTATTAC TGTCAGGCGTGGGAGAGCACTGGTATTGGCTGCGGACCAAGCTGACCGTCCTA |
| 1528 | VL of CDH19 14303 CC x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |
| 1529 | VH-VL of CDH19 14303 CC x I2C x FcBγ | artificial | nt | CAACGTTTCTGTACCGGTCACTTCGGTGGTCTGTACCCGTGGTCTGGTGGTTCGCAGGTGCAGTTGGTGGAGTCTGG GGGAGGCGTGGTCCAGCCTGGGAGGTCCCAGACTCTCCTGTGCAGCGTCTGGATTCACCTTCAGTAGCTATGGCATGCACTGGG TCCGCCAGGCTCCAGGCAAGTGTCTGGAGTGGGTGGCATTTATAATGGAAGTAATAAATACTATGCAGAGTCCGTGAAG GACCGATTCACCATCTCCAGAGACAATTCCAAGAACACGCTGTATCTGCAAATGAAAAGCCTGAGAGCTGAGGACACGGCTGTGTA TTACTGTGCGAGAAGGCGGAGATCTGGTGGCGGTGGTTCTGGCGGTGGTCTGGGGAGAGGTCTCTGGAGATAGGTTGGGGGAAAAAAATATACTAGCTGTATCAGCAGAGCCAGG TCCCCCAGGACAGACAGCAGCCAGCATCACCTGCTCTGGAGATAGGTTGGGGGAAAAAAATATACTAGCTGTATCAGCAGAGCCAGG CCAGTCCCCTTTGCTGGTCATCTATCAAGATACCAAGCGGCCCTCAGGGATTCTCTGAGCGATTCTCTGGCTCCAACTCTGGTAACA CAGCCACTCTGACCATCAGCGGACCCAGGCTGACTGATGAGGCTGACTATTACTGTCAGGCGTGGGAGAGCACTGGTATTC GGCTGCGGGACCAAGCTGACCGTCCTA |
| 1530 | VH-VL of CDH19 14303 CC x I2C x FcBγ | artificial | AA | QRFCTGHFGGLYPCNGGGGSQVQLVESGGGVVQPGRSLRLSCAASGFTFSSYGMHWVRQAPGKCLEWVAPIWYEGSNKYYAESVK DRFTISRDNSKNTLYLQMKSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVL |
| 1531 | CDH19 14303 CC x I2C x FcBγ | artificial | aa | QRFCTGHFGGLYPCNGGGGSQVQLVESGGGVVQPGRSLRLSCAASGFTFSSYGMHWVRQAPGKCLEWVAPIWYEGSNKYYAESVK DRFTISRDNSKNTLYLQMKSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSQVVTQEPSLTVSPGGT VTLTCGSSTGAVTSGNYPNWVQQKPGQAPRGLIGGTKFLAPGTPARFSGSLLGGKAALTLSGVQPEDEAEYYCVLMYSNRWVFGGG TKLTVLGGGGSQRFCTGHFGGLHPCNGHHHHHH |
| 1532 | VH of CDH19 14039 CC x I2C | artificial | nt | CAGGTGCAGTTGGTGGAGTCTGGGGGAGGCGTGGTCCAGCCTGGGTCCCTGAGACTCTCCTGTGCAGCCTCTGGATTCACCTT CAGTAGCTATGGCATGCACTGGGTCCGCCAGGCTCCAGGCAAGGTCTCGGAGTGGGTGGCATTTATATATGGTATGAGGGAAGTAATAA AATACTATGCAGAGTCCGTGAAGGACCGATTCACCATCTCCAGAGACAATTCCAAGAACACGCTGTATCTGCAAATGAATAGCCTG AGAGCTGAGGACACGGCTGTGTATTACTGTGCGAGAAGGGCCGGTATAATAGGAACTATAGGCTACTACTACGGTATGGACGTCTG GGGCCAAGGGACCACCGTCACCGTCTCCTAGT |
| 1533 | VH of CDH19 14039 CC x I2C | artificial | AA | QVQLVESGGGVVQPGSLRLSCAASGFTFSSYGMHWVRQAPGKCLEWVAPIWYEGSNKYYAESVKDRFTISRDNSKNTLYLQMNSL RAEDTAVYYCARRAGIIGTIGYYYGMDVWGQGTTVTVSS |
| 1534 | VL of CDH19 14039 CC x I2C | artificial | nt | TCCTATGAACTGACTCAGCCACCCTCAGTGTCCGTGTCCCAGGACAGACAGCATCACCTGCTCTGGAGATAGGTTGGGGA AAATATACTAGCTGTATACAGAGGCCAGTGGGACAGAGCCAGGCTCATCTATCAAGATACCAAGCGGCCCTCAGGGATCC CTGAGCGATTCTCTGGCTCCAACTCTGGTAACACAGCCACTCTGACCATCAGCGGACCCAGGCTATGGATGAGGCTGACTATTAC TGTCAGGCGTGGGAGAGCACTGGTATTGGCTGCGGACCAAGCTGACCGTCCTA |

TABLE VI-continued

| SEQ ID NO. | DESIGNATION | SOURCE | TYPE | SEQUENCE |
|---|---|---|---|---|
| 1535 | VL of CDH19 14039 CC x I2C | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |
| 1536 | VH-VL of CDH19 14039 CC x I2C | artificial | nt | CAGGTCGAGTTGGTGGAGTCTGGGGGAGGCTGGTCCAGCCTGGGGGTCCTGAGACTCTCCTGTGCAGCGTCTGGATTCACCTT CAGTAGCTATGGCATGCACTGGGTCCGCCAGGCTCCAGGCAAGGGTCTGGAGTGGGTGGCATTTATATGGTATGAGGAAGTAATA AATACTATGCAGAGTCCGTGAAGGACCGATTCACCATCTCCAGAGACAATTCCAAGAACACGCTGTATCTGCAAATGAATAGCCTG AGAGCTGAGGACACCGCCGTGTATTACTGTGCGAAAGGCCGGTATAATAGGAGCTTGTGGCCGTGTTCTTGGCCGCGAGGCTCTGTG GGGCCAAGGGACCACGGTCACCGTCTCTAGTGAGTGGAGGCGGAGATCTGGAGGCGGAGGCCAGCAGCAGCCAGCAGCAGATAAC TGATCCAGCCACCTCAGTGTCCTGCTCCCAGGACAGAGACAGCCATCACCTGCTCTGGAGATAGTTGGGGAAAATATACT AGCTGGTATCAGCAGAGGCCAGGCCAGTCCCCTTGCTGACCATCAGCGGGACCATCAGCGACCCAGGCTATGGATGAGGCTGATTACTGTCAGGCGT CTCTGCCTCCAACTCTGGTAACACAGCCATCTCGCCTCGACCCAGCGTGCCGGACCCAAGCTGACCGTCCTA GGGAGAGCAGCACTGTGGTATTCGGCTGCGGGACCAAGCTGACCGTCCTA |
| 1537 | VH-VL of CDH19 14039 CC x I2C | artificial | AA | QVQLVESGGGVVQPGGSLRLSCAASGFTFSSYGMHWVRQAPGKCLFWVAFIWYEGSNKYYAESVKDRFTISRDNSKNTLYLQMNSL RAEDTAVYYCARRAGIIGTIGYYYGMDVWGQGTTVTVSSGGGGSGGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVL |
| 1538 | CDH19 14039 CC x I2C | artificial | | QVQLVESGGGVVQPGGSLRLSCAASGFTFSSYGMHWVRQAPGKCLFWVAFIWYEGSNKYYAESVKDRFTISRDNSKNTLYLQMNSL RAEDTAVYYCARRAGIIGTIGYYYGMDVWGQGTTVTVSSGGGGSGGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVSPGGTVTLTCSSSTGAVTSGNYPNWV SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNPGNSYISYWAYWGQGTLVTVSSGGGGSGGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLHHHHHH |
| 1539 | CDH19 14039 x F12q0 | artificial | | QVQLVESGGGVVQPGGSLRLSCAASGFTFSSYGMHWVRQAPGKCLFWVAFIWYEGSNKYYAESVKDRFTISRDNSKNTLYLQMNSL RAEDTAVYYCARRAGIIGTIGYYYGMDVWGQGTTVTVSSGGGGSGGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLRLSCAASGFTFNSYAMNWVRQAPGKGLEWVARIRSKYNNYATYYADSVKGRFTISRDDSKNTAYLQMNSLKTED TAVYYCVRHGNFGNSYVSWNAYWGQGTLVTVSSGGGGSGGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVL |
| 1540 | CDH19 14039 CC x F12q0 | artificial | | QVQLVESGGGVVQPGGSLRLSCAASGFTFSSYGMHWVRQAPGKCLFWVAFIWYEGSNKYYAESVKDRFTISRDNSKNTLYLQMNSL RAEDTAVYYCARRAGIIGTIGYYYGMDVWGQGTTVTVSSGGGGSGGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLRLSCAASGFTFNSYAMNWVRQAPGKGLEWVARIRSKYNNYATYYADSVKGRFTISRDDSKNTAYLQMNSLKTED TAVYYCVRHGNFGNSYVSWNAYWGQGTLVTVSSGGGGSGGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVL |
| 1541 | VH of CDH19 21-14039 x I2C | artificial | nt | CGGCTGATCGAGGACATCCTGCCTCGCTGGTGCCTGGAGGACGACGACCAGGTGCAGTTGGTGGAGTCTGGGGGAGGCGT GGTCCAGCCTGGGGGGTCCTGAGACTCTCCTGTGCAGCGTCTGGATTCACCTTCAGTAGCTATGGCATGCACTGGGTCCGCCAGG CTCCAGGCAAGGGCTGGAGTGGGTGGCATTTATATGGTATGAGGAAGTAATAAATACTATGCAGAGTCCGTGAAGGACCGATTC ACCATCTCCAGAGACAATTCCAAGAACACGCTGTATCTGCAAATGAATAGCCTGAGAGCTGAGGACACGGCTGTGTATTACTGTGC GAGAAGGGCCGGTATAATAGGAACTATAGGACTACTACTACTACTACGGTATGGACGTCTGGGGCCAAGGGACCACGGTCACCGTCTCTAGT |
| 1542 | VH of CDH19 21-14039 x I2C | artificial | AA | RLIEDICLPRWGCLWEDDQVLVESGGGVVQPGGSLRLSCAASGFTFSSYGMHWVRQAPGKGLEWVAFIWYEGSNKYYAESVKDRF TISRDNSKNTLYLQMNSLRAEDTAVYYCARRAGIIGTIGYYYGMDVWGQGTTVTVSS |

TABLE VI-continued

| SEQ ID NO. | DESIGNATION | SOURCE | TYPE | SEQUENCE |
|---|---|---|---|---|
| 1543 | VL of CDH19 21-14039 x I2C | artificial | nt | TCCTATGAACTGACTCAGCCACCCTCAGTGTCCGTGTCCCAGGACAGACAGCCAGCATCACCTGCTCTGAGATAGGTTGGGGA AAATATACTACTGTGCTCGGCTCCAACTCTGGTACCACAGCCAGTCCCTTTGCTGACCATCAGCGGGACCCAGGCTATGATGAGGCTGACTATTAC CTGAGCGATTCTCTGGCTCCAACTCTGGTACCACAGCCAGTCCCTTTGCTGACCATCAGCGGGACCCAGGCTATGATGAGGCTGACTATTAC TGTCAGGCCTGGGAGAGCAGCACTGTGTATTCGGCGAGGACCAAGCTGACCGTCCTA |
| 1544 | VL of CDH19 21-14039 x I2C | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGGGTKLTVL |
| 1545 | VH-VL of CDH19 21-14039 x I2C | artificial | nt | CGGCTGATCGAGGACATCTGCCTGCCCAGATGGGGCTGCCTGTGGAGGACGACCAGGTGCAGTTGGTGGAGTCTGGGGGAGGCGT GGTCCAGCCTGGGGGGTCCCTGAGACTCTCCTGTGCAGCGTTCGGATTCACCTTCAGTAGCTATGGCATGCACTGGGTCCGCCAGG CTCCAGGCCAAGGGCTGGAGTGGGTGGCAGTTATATGGTATGAGGGAAGTAATAAATACTATGCAGATTCCGTGAAGGACCGATTC ACCATCTCCAGAGACAATTCCAAGAACACGCTGTATCTGCAAATGAATAGCCTGAGAGCTGAGGACACGGCTGTATTACTGTGC GAGAAGGGCCCGTATAATAGGAACATATAGGACCGGACCGGGAAGTGGAGGCTATCCTGATGAACTACTAGCTGGTATCACGAGGCCAGGCTTCTGACTGGGAGGCTATCAGCAGGACCAGGCCAGTCCC TGCGGAGACACCAGCCAGCATCACCTGCTCTGGAGATAGGTTGGGGAGAAAAATATACTACTGTGGTATCAGCAGGACCAGGCCAGTCCC TTTGCTGGTCATCTATCAAGATACCAAGCGATTCTCTGGCTCCAACTCTGGTACCACAGCCACTC TGACCATCAGCGGGACCCAGGCTATGATGAGGCTGACTATTACTGTCAGGCGTGGGAGAGCAGCACTGTGTATTCGGCGGAGGG ACCAAGCTGACCGTCCTA |
| 1546 | VH-VL of CDH19 21-14039 x I2C | artificial | AA | RLIEDICLPRWGCLWEDDQVQLVESGGGVVQPGGSLRLSCAASGFTFSSYGMHWVRQAPGKGLEWVAFIWYEGSNKYYAESVKDRF TISRDNSKNTLYLQMNSLRAEDTAVYYCARRAGIIGTIGYYYGMDVWGQGTTVTVSSGGGGSGGGGSYELTQPPSVSVSP GQTASITCSGDRLGEKYTSWYQQRPGQSPLLVIYQDTKRPSGIPERFSGSNSGNTATLTISGTQAMDEADYYCQAWESSTVVFGGG TKLTVL |
| 1547 | CDH19 21-14039 x I2C | artificial | nt | RLIEDICLPRWGCLWEDDQVQLVESGGGVVQPGGSLRLSCAASGFTFSSYGMHWVRQAPGKGLEWVAFIWYEGSNKYYAESVKDRF TISRDNSKNTLYLQMNSLRAEDTAVYYCARRAGIIGTIGYYYGMDVWGQGTTVTVSSGGGGSGGGGSYELTQPPSVSVSP GQTASITCSGDRLGEKYTSWYQQRPGQSPLLVIYQDTKRPSGIPERFSGSNSGNTATLTISGTQAMDEADYYCQAWESSTVVFGGG TKLTVLSGGGGSEVQLVESGGGLVQPGGSLKLSCAASGFTFNKYAMNWVRQAPGKGLEWVARIRSKYNNYATYYADSVKDRFTISR DDSKNTAYLQMNNLKTEDTAVYYCVRHGNEGNSYISYWAYWGQGTLVTVSSGGGGSQTVVTQEPSLTVSPGGTVTL TCGSSTGAVTSGNYPNWVQQKPGQAPRGLIGGTKFLAPGTPARFSGSLLGGKAALTLSGVQPEDEAEYYCVLWYSNRWVFGGGTKL TVLHHHHHH |
| 1548 | VH of CDH19 21-14039 CC x I2C | artificial | nt | CGGCTGATCGAGGACATCTGCCTGCCCAGATGGGGCTGCCTGTGGAGGACGACCAGGTGCAGTTGGTGGAGTCTGGGGGAGGCGT GGTCCAGCCTGGGGGGTCCCTGAGACTCTCCTGTGCAGCGTTCGGATTCACCTTCAGTAGCTATGGCATGCACTGGGTCCGCCAGG CTCCAGGCCAAGGGCTGGAGTGGGTGGCAGTTATATGGTATGAGGGAAGTAATAAATGAATAGCCTGAGAGCTGAGGACACGGCTGTATTACTGTGC ACCATCTCCAGAGACAATTCCAAGAACACGCTGTATCTGCAAATGAATAGCCTGAGAGCTGAGGACACGGCTGTATTACTGTGC GAGAAGGGCCCGTATAATAGGAACATATAGGACCTATGGACGTCTGGGGCCAAGGGACCACGGTCACCGTCTCCTCAGT |
| 1549 | VH of CDH19 21-14039 CC x I2C | artificial | AA | RLIEDICLPRWGCLWEDDQVQLVESGGGVVQPGGSLRLSCAASGFTFSSYGMHWVRQAPGKGLEWVAFIWYEGSNKYYAESVKDRF TISRDNSKNTLYLQMNSLRAEDTAVYYCARRAGIIGTIGYYYGMDVWGQGTTVTVSS |
| 1550 | VL of CDH19 21-14039 CC x I2C | artificial | nt | TCCTATGAACTGACTCAGCCACCCTCAGTGTCCGTGTCCCAGGACAGACAGCCAGCATCACCTGCTCTGAGATAGGTTGGGGA AAATATACTACTGTGCTCGGCTCCAACTCTGGTACCACAGCCAGTCCCTTTGCTGACCATCAGCGGGACCCAGGCTATGATGAGGCTGACTATTAC CTGAGCGATTCTCTGGCTCCAACTCTGGTACCACAGCCAGTCCCTTTGCTGACCATCAGCGGGACCCAGGCTATGATGAGGCTGACTATTAC TGTCAGGCCTGGGAGAGCAGCACTGTGTATTCGGCTGCCGGACCAAGCTGACCGTCCTA |
| 1551 | VL of CDH19 21-14039 CC x I2C | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGCGTKLTVL |

TABLE VI-continued

| SEQ ID NO. | DESIGNATION | SOURCE | TYPE | SEQUENCE |
|---|---|---|---|---|
| 1552 | VH-VL of CDH19 21-14039 CC x I2C | artificial | nt | CGGCTGATCGAGGACATCTGCCTGCCCAGATGGGCTGCTCTGTGGAGGACGACCAGGTGCAGTTGGTGGAGTCTGGGGGAGGCGT GGTCCAGCCTGGGGGGTCCCTGAGACTCTCCTGTGCAGCGTCTGGATTCACCTTCAGTAGCTATGGCATGCACTGGGTCCGCCAGG CTCCAGGCAAGTCTGGAGTTGGTGGCATTTATATGGATGGAAGTAATAAATACTATGCAGAGTCCGTGAAGGACCGATTC ACCATCTCCAGAGACAATTCCAAGAACACGCTGTATCTGCAAATGAACAGCCTGAGAGCTGAGGACACGGCTGTGTATTACTGTGC GAGAGGGCCGTATAATAGGAACTATAGGCTACTACTACGGTATGGACGTCTGGGGCCAAGGGACCACGGTCACCGTCTCTAGTG GAGGCGGAGGATCTGGTGGCGGTGGTTCTGGCGGCGGAGGCTCCATGGACTACAAATTGTGTTGACACAGTCCCCA GACAGACAGCCAGCATCACCTGCTCTGGAGATAAGCTGGGCAGATGGGGAGATGTTCGGTATGTGTATCAGCAGAGGCCAGGTCCC TTTGCTGGTCATCTATCAAGATAGCAAGCGGCCCCTCAGGATCCCTGAGCGATTCTCTGGCTCCAACTCTGTAACACAGCACTC TGACCATCAGCGGGACCCAGGCTGATGAGAGGCTGACTATACTGTCAGGCGTGGAGAGCAGCACTGTTCGGCTGTGCGGG ACCAAGCTGACCGTCCTA |
| 1553 | VH-VL of CDH19 21-14039 CC x I2C | artificial | AA | RLIEDICLPRWGCLWEDDQVQLVESGGGVVQPGGSLRLSCAASGFTFSSYGMHWVRQAPGKCLEWVAFIWYEGSNKYYAESVKDRF TISRDNSKNTLYLQMNSLRAEDTAVYYCARRAGIIGTIGYYYGMDVWGQGTTVTVSSGGGGSGGGGSSVELTQPPSVSVSP GQTASITCSGDRLGEKYTSWYQQRPGQSPLLVIYQDTKRPSGIPERFSGSNGNTATLTISGTQAMDEADYYCQAWESSTVVFGCG TKLTVL |
| 1554 | CDH19 14039 CC x I2C | artificial | | RLIEDICLPRWGCLWEDDQVQLVESGGGVVQPGGSLRLSCAASGFTFSSYGMHWVRQAPGKCLEWVAFIWYEGSNKYYAESVKDRF TISRDNSKNTLYLQMNSLRAEDTAVYYCARRAGIIGTIGYYYGMDVWGQGTTVTVSSGGGGSGGGGSSVELTQPPSVSVSP GQTASITCSGDRLGEKYTSWYQQRPGQSPLLVIYQDTKRPSGIPERFSGSNGNTATLTISGTQAMDEADYYCQAWESSTVVFGCG TKLTVLSGGGGSEVQLVESGGGLVQPGGSLKLSCAASGFTFNKYAMNWVRQAPGKGLEWVARIRSKYNNYATYYADSVKDRFTISR DDSKNTAYLQMNNLKTEDTAVYYCVRHGNFGNSYISYWAYWGQGTLVTVSSGGGGSGGGGSQTVVTQEPSLTVSPGGTVTL TCGSSTGAVTSGNYPNWVQQKPGQAPRGLIGGTKFLAPGTPARFSGSLLGGKAALTLSGVQPEDEAEYYCVLWYSNRWVFGGGTKL TVLHHHHHH |
| 1555 | CDH19 14039 x I2C | artificial | | QVQLVESGGGVVQPGGSLRLSCAASGFTFSSYGMHWVRQAPGKCLEWVAFIWYEGSNKYYAESVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLITVLRLIEDICLPRWGCLW EDDHHHHHH |
| 1556 | CDH19 14039 x I2C-21 | artificial | | QVQLVESGGGVVQPGGSLRLSCAASGFTFSSYGMHWVRQAPGKCLEWVAFIWYEGSNKYYAESVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLITVLRLIEDICLPRWGCLW EDDHHHHHH |
| 1557 | VH of CDH19 14039 x I2C x FcBγ | artificial | nt | CAACGTTTCTGTACCGGTCACTTCGTGTGCTGTGTCGTGTCTCCGTGTAATGTGGCAGTCCAGGTGCAGTTGGTGGAGTCTGG GGGAGGCGTGGTCCAGCCTGGGGGGTCCCTGAGACTCTCCTGTGCAGCCTCTGGATTCACCTTCAGTAGCTATGGCATGCACTGGG TCCGCCAGGCTCCAGGCAAGGGGCTGGAGTGGGTGGCATTTATATGGTATGAGGGAAGTAATAAATACTATGCAGAGTCCGTGAAG GACCGATTCACCATCTCCAGAGACAACTCCAAGAACACGCTGTATCTGCAAATGAATAGCCTGAGAGCTGAGGACACGGCTGTGTA TTACTGTGCGAGAGGGCCGTATAATAGGAACTATAGGCTACTACTACGGTATGGACGTCTGGGGCCAAGGGACCACGGTCACCG TCTCTAGT |
| 1558 | VH of CDH19 14039 x I2C x FcBγ | artificial | AA | QRFCTGHEGGLYPCNGGGGGSQVQLVESGGGVVQPGGSLRLSCAASGFTFSSYGMHWVRQAPGKGLEWVAFIWYEGSNKYYAESVK DRFTISRDNSKNTLYLQMNSLRAEDTAVYYCARRAGIIGTIGYYYGMDVWGQGTTVTVSS |

TABLE VI-continued

| SEQ ID NO. | DESIGNATION | SOURCE | TYPE | SEQUENCE |
|---|---|---|---|---|
| 1559 | VL of CDH19 14039 x I2C x FcBγ | artificial | nt | TCCTATGAACTGACTCAGCCACCCTCAGTGTCCGTGTCCCCAGGACAGAGCCAGCCATCACCTGCTCTGAGATAGGTTGGGGA AAAATATACTAGCTGGTATCAGCAGAGGCCAGGCCAGTCCCCTTTGCTGCTCATTATCAAGATACCAAGCGGCCCTCAGGGATCC CTGAGGCGATTCTCTGCCTCCAACTCTGGTAACACAGCCACTCTGACCATCAGCGGACCCAGGCTATGGATGAGGCTGACTATTAC TGTCAGCGTGGGAGAGCACACTGTGTATTCGGCGGAGGGACCAAGCTGACCGTCCTA |
| 1560 | VL of CDH19 14039 x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGGGTKLTVL |
| 1561 | VH-VL of CDH19 14039 x I2C x FcBγ | artificial | nt | CAACGTTTCTGTACCGTCACTTCGGTGTCTGTACCCGTGGTCTTGATCCCTGTAATGTGTGGTGGTTCGCAGGTGCAGTTGGTGGAGTCTGG GGGAGGCGTGGTCCAGCCTGGGGGTCCCTGAGACTCTCCTGTGCAGCTTCAGTAGCTATGGCATGCATTGGG TCCGCCAGGCTCCAGGCAAGGGCTGAGTGGGTGGCATTTATATGTATGAGGAAGTAATAATATATATCAGAGTCCTGAAG GACCGATTCACCATCTCCAGAGACAATTCCAAGAACACGCTGTATCTGCAAATGAATAGCCTGAGAGCTGAGGACACGGCTGTGTA TTACTGTGCGAGAAGGGCCGGTATATAGGAACTATAGGCTACTACTACGGTATGGACGTCTGGGGCCAAGGGACCACGGTCACCG TGTCCCCAGGACAGAGACCAGCATCACAGCGCCCTCTGAGGTGGAAGCAGCAGATATACCAAGCGGCCCTCAGCGAGGCCAGG CCAGTCCCCTTTGCTGCTGACCATCAGCGGACACCCAGGCTATGGATGAGGCTGACTATTACTGTCAGCGTGGGAGAGCACTCTGGTAACA GCAGCACTGTGGTTCGGCGGAGGGACCAAGCTGACCGTCCTA |
| 1562 | VH-VL of CDH19 14039 x I2C x FcBγ | artificial | AA | QRFCTGHFGGLYPCNGGGGGSQVQLVESGGGVVQPGGSLRLSCAASGFTFSSYGMHWVRQAPGKGLEWVAFIWYEGSNKYYAESVK DRFTISRDNSKNTLYLQMNSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GGGTKLTVL |
| 1563 | CDH19 14039 x I2C x FcBγ | artificial | AA | QRFCTGHFGGLYPCNGGGGGSQVQLVESGGGVVQPGGSLRLSCAASGFTFSSYGMHWVRQAPGKGLEWVAFIWYEGSNKYYAESVK DRFTISRDNSKNTLYLQMNSLRAEDTAVYYCARRAGIIGTIGYYYGMDVWGQGTTVTVSSGGGGSGGGGSGGGGSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GGGTKLTVLSGGGGSEVQLVESGGGLVQPGGSLKLSCAASGFTFNKYAMNWVRQAPGKGLEWVARIRSKYNNYATYADSVKDRFT ISRDDSKNTAYLQMNNLKTEDTAVYYCVRHGNFGNSYISWAYWGQGTLVTVSSGGGGSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGSQRFCTGHFGGLHPCNGHHHHHH |
| 1564 | VH of CDH19 14039 CC x I2C x FcBγ | artificial | nt | CAACGTTTCTGTACCGTCACTTCGGTGTCTGTACCCGTGGTCTTGATCCCTGTAATGTGTGGTGGTTCGCAGGTGCAGTTGGTGGAGTCTGG GGGAGGCGTGGTCCAGCCTGGGGGTCCCTGAGACTCTCCTGTGCAGCTTCAGTAGCTATGGCATGCATTGGG TCCGCCAGGCTCCAGGCAAGTGTCTGAGTGGGTGGCATTTATATGTATGAGGAAGTAATAATATATCAGAGTCCTGAAG GACCGATTCACCATCTCCAGAGACAATTCCAAGAACACGCTGTATCTGCAAATGAATAGCCTGAGAGCTGAGGACACGGCTGTGTA TTACTGTGCGAGAAGGGCCGGTATATAGGAACTATAGGCTACTACTACGGTATGGACGTCTGGGGCCAAGGGACCACGGTCACCG TCTCTAGT |
| 1565 | VH of CDH19 14039 CC x I2C x FcBγ | artificial | AA | QRFCTGHFGGLYPCNGGGGGSQVQLVESGGGVVQPGGSLRLSCAASGFTFSSYGMHWVRQAPGKGLEWVAFIWYEGSNKYYAESVK DRFTISRDNSKNTLYLQMNSLRAEDTAVYYCARRAGIIGTIGYYYGMDVWGQGTTVTVSS |
| 1566 | VL of CDH19 14039 CC x I2C x FcBγ | artificial | nt | TCCTATGAACTGACTCAGCCACCCTCAGTGTCCGTGTCCCCAGGACAGAGACCAGCCATCACCTGCTCTGAGATAGGTTGGGGA AAAATATACTAGCTGGTATCAGCAGAGGCCAGGCCAGTCCCCTTTGCTGCTCATTATCAAGATACCAAGCGGCCCTCAGGGATCC CTGAGCGATTCTCTGCCTCCAACTCTGGTAACACAGCCACTCTGACCATCAGCGGACCCAGGCTATGGATGAGGCTGACTATTAC TGTCAGCGTGGGAGAGCACAGCACTGTGGTTCGGCGGAGGGACCAAGCTGACCGTCCTA |

TABLE VI-continued

| SEQ ID NO. | DESIGNATION | SOURCE | TYPE | SEQUENCE |
|---|---|---|---|---|
| 1567 | VL of CDH19 14039 CC x I2C x FcBγ | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVFGCGTKLTVL |
| 1568 | VH-VL of CDH19 14039 CC x I2C x FcBγ | artificial | nt | CAACGTTTCTGTACCGGTCACTTCGGTGGTCTGTACCCGTGGTGTGTGCAGTGCAGTAGTAGTGGAGTCTGG GGGAGGCGTGTCCAGCCTGGGGGTCCCTGAGACTCTCCTGTGCAGCTTCTGGATTCACCTTCAGTAGCTATGGCATGCACTGGG TCCGCCAGGCTCCAGGGAAGGTGTCTGGAGTGGGTGGCATTATATGGTATGATGAGGGAAGTAATAATACTATGCAGAGTCCTGAAG GACCGATTCACCATTCTCCAGAGACAATTCCAAGAACACGCTGTATCTGCAAATGAATAGCCTGAGAGCTGAGGACACGGCTGTGTA TTACTGTGCGAGAAGGGCCGTATAATAGGACTACTACTGGTACTTCGATGCTTGGGGCCAAGGAACCCTGGTCACCGTCTCACCG TCTCAGTGGAGGCGGAGATCTGGTGGCGGTGGCTCTGGCGGAGGCTCCTCCTATGAACTGACTCAGCCACCCTCAGTGTCC GTGTCCCCAGGACAGACAGCCAGCATCACTTGCTCTGGAGATAGGTTGGGGAAAAAATATACTAGCTGGTATCAGCAGAGGCCAGG CAGTCCCCTTTGCTGCTCATCTATCAAGATACCAAGCGGCCCTCAGGGATCCTGAGCGATTCTCTGGCTCCAACTCTGGGAACA CAGCCACTCTGACCATCAGCGGACCCAGGCTATGAGGCTGACTATTACTGTCAGGCAGACACTGTGTATTC GGCTGCCGGAGCCAAGCTGACCGTCCTA |
| 1569 | VH-VL of CDH19 14039 CC x I2C x FcBγ | artificial | AA | QRFCTGHFGGLYPCNGGGGSQVQLVESGGGVVQPGGSLRLSCAASGFTFSSYGMHWVRQAPGKLEWVAFIWYEGSNKYYAESVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVF GCGTKLTVL |
| 1570 | CDH19 14039 CC x I2C x FcBγ | artificial | | QRFCTGHFGGLYPCNGGGGSQVQLVESGGGVVQPGGSLRLSCAASGFTFSSYGMHWVRQAPGKLEWVAFIWYEGSNKYYAESVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVF GCGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGSQRFCTGHFGGLHPCNGHHHHHH |
| 1571 | CDH19 14302 x I2C-156 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLGGGGSRDWDFD VFGGGTPVGHHHHHH |
| 1572 | CDH19 14302 x I2C-LFcBγ | artificial | aa | QRFVTGHFGGLYPANGGGGGSQVQLVESGGGVVQPGGSLRLSCAASGFTFSSYGMHWVRQAPGKGLEWVAFIWYDGSNKYYADSVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVF GGGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGS QRFCTGHFGGLHPCNGHHHHHH |
| 1573 | CDH19 14302 x I2C-LFcBγ 156 | artificial | aa | QRFVTGHFGGLYPANGGGGGSQVQLVESGGGVVQPGGSLRLSCAASGFTFSSYGMHWVRQAPGKGLEWVAFIWYDGSNKYYADSVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVF GGGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYWAYWGQGTLVTVSSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGS QRFCTGHFGGLHPCNGGGGSGGGGSRDMFDFDVFGGGTPVGHHHHHH |

TABLE VI-continued

| SEQ ID NO. | DESIGNATION | SOURCE | TYPE | SEQUENCE |
|---|---|---|---|---|
| 1574 | CDH19 14302 x I2C-Cys-Loop | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLCGCGGGGCHHHHHH |
| 1575 | CDH19 14302 x I2C-HALB | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLPGGGSDAHKSEVAH RFKDLGEENFKALVLIAFAQYLQQCPFEDHVKLVNEVTEFAKTCVADESAENCDKSLHTLFGDKLCTVATLRETYGEMADCCAKQE PERNECFLQHKDDNPNLPRLVRPEVDVMCTAFHDNEETFLKKYLYEIARRHPYFYAPELLFFAKRYKAAFTECCQAADKAACLLPK LDELRDEGKASSAKQRLKCASLQKFGERAFKAWAVARLSQRFPKAEFAEVSKLVTDLTKVHTECCHGDLLECADDRADLAKYICEN QDSISSKLKECCEKPLLEKSHCIAEVENDEMPADLPSLAADFVESKDVCKNYAEAKDVFLGMFLYEYARRHPDYSVLLLRLAKTY ETTLEKCCAAADPHECYAKVFDEFKPLVEEPQNLIKQNCELFEQLGEYKFQNALLVRYTKKVPQVSTPTLVEVSRNLGKVGSKCCK HPEAKRMPCAEDYLVKHKPKATKEQLKAVMDDFAAFVEKCCKADDKETCFAEEGKKLVAASQAALGLDYHHHHHH |
| 1576 | CDH19 14302 x I2C-GS-D3HSA | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLNQLCVLHEKTPVSDRVTKC CTESLVNRRPCFSALEVDETYVPKEFNAETFTHADICTLSEKERQIKKQTALVELVKHKPKATKEQLKAVMDDFAAFVEKCCKAD DKETCFAEEGKKLVAASQAALGLHHHHHH |
| 1577 | CDH19 14302 x I2C-GS-D3HSA | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLPGGGGSGGGGSGGGG SEEPQNLIKQNCELFEQLGEYKFQNALLVRYTKKVPQVSTPTLVEVSRNLGKVGSKCCCKHPEAKRMPCAEDYLSVVLNQLCVLHEK TPVSDRVTKCCTESLVNRRPCFSALEVDETYVPKEFNAETFTHADICTLSEKERQIKKQTALVELVKHKPKATKEQLKAVMDDFA AFVEKCCKADDKETCFAEEGKKLVAASQAALGLHHHHHH |
| 1578 | CDH19 14302 x I2C-GS-D3HSA-156 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLNQLCVLHEKTPVSDRVTKC CTESLVNRRPCFSALEVDETYVPKEFNAETFTHADICTLSEKERQIKKQTALVELVKHKPKATKEQLKAVMDDFAAFVEKCCKAD DKETCFAEEGKKLVAASQAALGLGGGGSGGGGSRDWDFDVFGGGTPVGGHHHHHH |

TABLE VI-continued

| SEQ ID NO. | DESIGNATION | SOURCE | TYPE | SEQUENCE |
|---|---|---|---|---|
| 1579 | CDH19 14302 x I2C-3GS-D3HSA-156 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSYELTQPPSVSVSPGQTASITCSGDRLGEKYT SWYQQRPGQSPLLVIYQDTKRPSGIPERFSGSNSGNTATLTISGTQAMDEADYYCQAWESSTVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQGTLVTVSSGGGGSGGGGSGGGGSQTVVTQEPSLTVSPGGTVTLTCCSSTGAVTSGNYPNWV QQKPGQAPRGLIGGTKFLAPGTPARFSGSLLGGKAALTLSGVQPEDEAEYYCVLWYSNRWVFGGGTKLTVLPGGGSGGGGSGGGG SEEPQNLIKQNCELFEQLGEYKFQNALLVRYTKKVPQVSTPTLVEVSRNLGKVGSKCCCKHPEAKRMPCAEDYLSVVLNQLCVLHEK TPVSDRVTKCCTESLVNRRPCFSALEVDETVPKEFNAETFTFHADICTLSEKERQIKKQTALVELVKHKPKATKEQLKAVMDDFA AFVEKCCKADDKETCFAEEGKKLVAASQAALGLGGGGSGGGGSRDWDFDVFGGGTPVGGHHHHHH |
| 1580 | CDH19 14302 x I2C-GS-D3HSA-21 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQGTLVTVSSGGGGSGGGGSGGGGSQTVVTQEPSLTVSPGGTVTLTCCSSTGAVTSGNYPNWV QQKPGQAPRGLIGGTKFLAPGTPARFSGSLLGGKAALTLSGVQPEDEAEYYCVLWYSNRWVFGGGTKLTVLPGGGSEEPQNLIKQ NCELFEQLGEYKFQNALLVRYTKKVPQVSTPTLVEVSRNLGKVGSKCCCKHPEAKRMPCAEDYLSVVLNQLCVLHEKTPVSDRVTKC CTESLVNRRPCFSALEVDETVPKEFNAETFTFHADICTLSEKERQIKKQTALVELVKHKPKATKEQLKAVMDDFAAFVEKCCKAD DKETCFAEEGKKLVAASQAALGLGGGGSGGGGSRLIEDICLPRWGCLWEDDHHHHHH |
| 1581 | CDH19 14302 x I2C-3GS-D3HSA-21 | artificial | aa | QVQLVESGGGVVQPGGSLRLSCAASGFTFSSYGMHWVRQAPGKGLEWVAFIWYDGSNKYYADSVKDRFTISRDNSKNTLYLQMNSL RAEDTAVYYCARRAGIIGTIGYYYGMDVWGQGTTVTVSSGGGGSGGGGSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYNAYWGQGTLVTVSSGGGGSGGGGSGGGGSQTVVTQEPSLTVSPGGTVTLTCCSSTGAVTSGNYPNWV QQKPGQAPRGLIGGTKFLAPGTPARFSGSLLGGKAALTLSGVQPEDEAEYYCVLWYSNRWVFGGGTKLTVLPGGGSGGGGSGGGG SEEPQNLIKQNCELFEQLGEYKFQNALLVRYTKKVPQVSTPTLVEVSRNLGKVGSKCCCKHPEAKRMPCAEDYLSVVLNQLCVLHEK TPVSDRVTKCCTESLVNRRPCFSALEVDETVPKEFNAETFTFHADICTLSEKERQIKKQTALVELVKHKPKATKEQLKAVMDDFA AFVEKCCKADDKETCFAEEGKKLVAASQAALGLGGGGSGGGGSRLIEDICLPRWGCLWEDDHHHHHH |
| 1582 | CDR-H1 of CDH19 65231.002 | artificial | AA | SYYWS |
| 1583 | CDR-H2 of CDH19 65231.002 | artificial | AA | YIYYSGSTNYNPSLKS |
| 1584 | CDR-H3 of CDH19 65231.002 | artificial | AA | DQRRIAAAGTHFYGMDV |
| 1585 | CDR-L1 of CDH19 65231.002 | artificial | AA | RASQSVSSSYLA |
| 1586 | CDR-L2 of CDH19 65231.002 | artificial | AA | GTSSRAT |

TABLE VI-continued

| SEQ ID NO. | DESIGNATION | SOURCE | TYPE | SEQUENCE |
|---|---|---|---|---|
| 1587 | CDR-L3 of CDH19 65231.002 | artificial | AA | QQYGSSPFT |
| 1588 | VH of CDH19 65231.002 | artificial | NT | CAGGTGCAGCTGCAGGAATCCGGCCCTGGCCAAGCCTCCGGACACTGTCCTGACCTGTCCGGCGACTCCAT CACCTCCTACTACTGTCCTGGATCCGGCAGCCCTGGAAGGGCTGGAATGATCGGCTACATCTACTACTCCGGCTCCACCA ACTACAACCCCAGCCTGAAGTCCAGATGACCATTCCGTGACACCTCCAAGAACCAGTTCTCCCTGAAGCTGTCTCCGTGACC GCCGCTGACACCGCCGTGTACTACTGCGCCAGGGACCAGCGGGAGAATCGCCGCTGCCGGCACCCACTTCTACGGATGATGTGTG GGGCCAGGGCACCCTGTGACCGTGTCTAGC |
| 1589 | VH of CDH19 65231.002 | artificial | AA | QVQLQESGPGLAKPSETLSLTCTVSGDSITSYYWSWIRQPPGKGLEWIGYIYYSGSTNYNPSLKSRVTISVDTSKNQFSLKLSSVT AADTAVYYCARDQRRIAAAGTHFYGMDVWGQGTLVTVSS |
| 1590 | VL of CDH19 65231.002 | artificial | NT | GAGATCGTGCTGACCCAGTCCCCTGGCACCCTGTCCCTGAGCCCTGGCGAGAGACCACCCTGTCCTGCAGAGCCTCCCAGTCCGT GTCCTCCTACCTGGCCTGGTATCAGCAGAAGCCCGGCCAGGCCCCTCGGCTGCTGATCTACGGACGCTCCAATCGGGCTACCGGCACCG GCATCCCTGACAGGTTCTCCGGCTCTGGCTCCGGCACCGACTTCACCCTGACCATCAGCCGGCTGGAACCCGAGGACTTCGCTGTG TACTATTGCCAGCAGTACGGCTCCAGCCCCTTCACCTTCGGCGGAGGCACCAAGGTGGAAATCAAGTCC |
| 1591 | VL of CDH19 65231.002 | artificial | AA | EIVLTQSPGTLSLSPGERATLSCRASQSVSSSYLAWYQQKPGQAPRLLIYGTSSRATGIPDRFSGSGSGTDFTLTISRLEPEDFAV YYCQQYGSSPFTFGGGTKVEIKS |
| 1592 | VH-VL of CDH19 65231.002 | artificial | NT | CAGGTGCAGCTGCAGGAATCCGGCCCTGGCCAAGCCTCCGGACACTGTCCTGACCTGTCCGGCGACTCCAT CACCTCCTACTACTGTCCTGGATCCGGCAGCCCTGGAAGGGCTGGAATGATCGGCTACATCTACTACTCCGGCTCCACCA ACTACAACCCCAGCCTGAAGTCCAGATGACCATTCCGTGACACCTCCAAGAACCAGTTCTCCCTGAAGCTGTCTCCGTGACC GCCGCTGACACCGCCGTGTACTACTGCGCCAGGGACCAGCGGGAGAATCGCCGCTGCCGGCACCCACTTCTACGGATGATGTGTG GGGCCAGGGCACCCTGTGACCGTGTCTTCCGGCGGAGGCTCCGGAGAGCCTCCCAGTCCGTCCTCCTCC TACCTGGCCTGGTATCAGCAGAAGCCCGGCCAGGCCCCTCGGCTGCTGATCTACGGACGCTCCAATCAGCCGCTACCGGCATCCCTGA CCGGTTCTCCGGCTCTGGCTCCGGCACCGACTTCACCCTGCCGGAGGACACCGAGGACTTCGCTGTGTACTATTGCC AGCAGTACGGCTCCAGCCCCTTCACCTTCGGCGGAGGCACCAAGGTGGAAATCAAGTCC |
| 1593 | VH-VL of CDH19 65231.002 | artificial | AA | QVQLQESGPGLAKPSETLSLTCTVSGDSITSYYWSWIRQPPGKGLEWIGYIYYSGSTNYNPSLKSRVTISVDTSKNQFSLKLSSVT AADTAVYYCARDQRRIAAAGTHFYGMDVWGQGTLVTVSSGGGGSGGGGSGGGGSEIVLTQSPGTLSLSPGERATLSCRASQSVSSS YLAWYQQKPGQAPRLLIYGTSSRATGIPDRFSGSGSGTDFTLTISRLEPEDFAVYYCQQYGSSPFTFGGGTKVEIKS |
| 1594 | CDH19 65231.002 x I2C | artificial | AA | QVQLQESGPGLAKPSETLSLTCTVSGDSITSYYWSWIRQPPGKGLEWIGYIYYSGSTNYNPSLKSRVTISVDTSKNQFSLKLSSVT AADTAVYYCARDQRRIAAAGTHFYGMDVWGQGTLVTVSSGGGGSGGGGSGGGGSEIVLTQSPGTLSLSPGERATLSCRASQSVSSS YLAWYQQKPGQAPRLLIYGTSSRATGIPDRFSGSGSGTDFTLTISRLEPEDFAVYYCQQYGSSPFTFGGGTKVEIKSGGGGSEVQL VESGGGVQPGGSLKLSCAASGFTFNKYAMNWVRQAPGKGLEWVARIRSKYNNYATYYADSVKDRPTISRDDSKNTAYLQMNNLKT EDTAVYYCVRHGNFGNSYISYWAYWGQGTLVTVSSGGGGSGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPEDEAEYYCVLMYSNRWVFGGGTKLTVLHHHHHH |
| 1595 | CDR-H1 of CDH19 65231.003 | artificial | AA | SYYWS |
| 1596 | CDR-H2 of CDH19 65231.003 | artificial | AA | YIYYSGSTNYNPSLKS |

TABLE VI-continued

| SEQ ID NO. | DESIGNATION | SOURCE | TYPE | SEQUENCE |
|---|---|---|---|---|
| 1597 | CDR-H3 of CDH19 65231.003 | artificial | AA | DQRRIAAAGTHFYGMDV |
| 1598 | CDR-L1 of CDH19 65231.003 | artificial | AA | RASQSVSSSYLA |
| 1599 | CDR-L2 of CDH19 65231.003 | artificial | AA | GTSSRAT |
| 1600 | CDR-L3 of CDH19 65231.003 | artificial | AA | QQYGSSPFT |
| 1601 | VH of CDH19 65231.003 | artificial | NT | CAGGTGCAGCTGCAGGAGTCCGGCCCAGGACTGGTCAAGCCCTCGGCCAAGCCCTGTCCTGACCTGTCCGGCGGCTCCAT CACTTCCACTACTGGTCCTGGAATCCGGCTGGATCCGGCAGCCCCTGGCAGGGCCTGGAATGGATCGGCTACATCTACTACCACCA ACTACAACCCCAGCCTGAAGTCCAGAGTGACCATCTCCGTGGACACCTCCAAGAACCAGTTCTCCCTGAAGCTGTCCTCCGTGACC GCCGCTGACACCGCCGTGTACTACTGCGCCAGGGACCAGCGGAGAATCGCCGCTGCCGGCACCCACTTCTACGGCATGGATGTGTG GGGCCAGGGCACCCTGGTGACCGTGTCTAGC |
| 1602 | VH of CDH19 65231.003 | artificial | AA | QVQLQESGPGLVKPSETLSLTCTVSGGSITSYYWSWIRQPPGKGLEWIGYIYYSGSTNYNPSLKLSSVT AADTAVYYCARDQRRIAAAGTHFYGMDVWGQGTLVTVSS |
| 1603 | VL of CDH19 65231.003 | artificial | NT | GAGATCGTGCTGACCCAGTCCCCTGGCACCCTGAGCCTGTCCCCAGGCGAGCGGGCCACCCTGTCCTGCAGAGCCTCCCAGTCCGT GTCCTCCTCCTACCTGGCCTGGTATCAGCAGAAGCCCGGCCAGGCCCCTCGGCTGCTGATCTACGGCACCTCCTCCAGAGCCACCG GCATCCCTGACCGGTTCTCCGGCTCTGGCTCCGGCACCGACTTCACCCTGACCATCAGCCGGCTGGAACCCGAGGACTTCGCTGTG TACTATTGCCAGCAGTACGGCTCCAGCCCTTCACCTTCGGCCAAGGCACCAAGGTGGAAATCAAGTCC |
| 1604 | VL of CDH19 65231.003 | artificial | AA | EIVLTQSPGTLSLSPGERATLSCRASQSVSSSYLAWYQQKPGQAPRLLIYGTSSRATGIPDRFSGSGSGTDFTLTISRLEPEDFAV YYCQQYGSSPFTFGQGTKVEIKS |
| 1605 | VH-VL of CDH19 65231.003 | artificial | NT | CAGGTGCAGCTGCAGGAGTCCGGCCCAGGACTGGTCAAGCCCTCGGCCAAGCCCTGTCCTGACCTGTCCGGCGGCTCCAT CACTTCCACTACTGGTCCTGGAATCCGGCTGGATCCGGCAGCCCCTGGCAGGGCCTGGAATGGATCGGCTACATCTACTACCACCA ACTACAACCCCAGCCTGAAGTCCAGAGTGACCATCTCCGTGGACACCTCCAAGAACCAGTTCTCCCTGAAGCTGTCCTCCGTGACC GCCGCTGACACCGCCGTGTACTACTGCGCCAGGGACCAGCGGAGAATCGCCGCTGCCGGCACCCACTTCTACGGCATGGATGTGTG GGGCCAGGGCACCCTGGTGACCGTGTCTAGCGGCGGAGGATCCGGTGGTTCTGGCGGCGGTGGCTCCGGAGATCGTGC TGACCCAGTCCCCTGGCACCCTGAGCCTGTCCCCAGGCGAGCGGGCCACCCTGTCCTGCAGAGCCTCCCAGTCCGTGTCCTCC TACCTGGCCTGGTATCAGCAGAAGCCCGGCCAGGCCCCTCGGCTGCTGATCTACGGCACCTCCTCCAGAGCCACCGGCATCCCTGA CCGGTTCTCCGGCTCTGGCTCCGGCACCGACTTCACCCTGACCATCAGCCGGCTGGAACCCGAGGACTTCGCTGTGTACTATTGCC AGCAGTACGGCTCCAGCCCTTCGGCCAAGGCACCAAGGTGGAAATCAAGTCC |
| 1606 | VH-VL of CDH19 65231.003 | artificial | AA | QVQLQESGPGLVKPSETLSLTCTVSGGSITSYYWSWIRQPPGKGLEWIGYIYYSGSTNYNPSLKSRVTISVDTSKNQFSLKLSSVT AADTAVYYCARDQRRIAAAGTHFYGMDVWGQGTLVTVSSGGGGSGGGGSGGGGSEIVLTQSPGTLSLSPGERATLSCRASQSVSSS YLAWYQQKPGQAPRLLIYGTSSRATGIPDRFSGSGSGTDFTLTISRLEPEDFAVYYCQQYGSSPFTFGQGTKVEIKS |
| 1607 | CDH19 65231.003 x I2C | artificial | AA | QVQLQESGPGLVKPSETLSLTCTVSGGSITSYYWSWIRQPPGKGLEWIGYIYYSGSTNYNPSLKSRVTISVDTSKNQFSLKLSSVT AADTAVYYCARDQRRIAAAGTHFYGMDVWGQGTLVTVSSGGGGSGGGGSGGGGSEIVLTQSPGTLSLSPGERATLSCRASQSVSSS YLAWYQQKPGQAPRLLIYGTSSRATGIPDRFSGSGSGTDFTLTISRLEPEDFAVYYCQQYGSSPFTFGQGTKVEIKSGGGGSEVQL VESGGGLVQPGGSLKLSCAASGFTFNKYAMNWVRQAPGKGLEWVARISRKYNNYATYYADSVKDRFTISRDDSKNTAYLQMNNLKT |

TABLE VI-continued

| SEQ ID NO. | DESIGNATION | SOURCE | TYPE | SEQUENCE |
|---|---|---|---|---|
| 1608 | CDR-H1 of CDH19 65234.001 | artificial | AA | EDTAVYYCVRHGNFGNSYISYWAYWGQGTLVTVSSGGGGSGGGGSGGGGSQTVVTQEPSLTVSPGGTVTLTCGSSTGAVTSGNYPN WVQQKPGQAPRGLIGGTKFLAPGTPARFSGSLLGGKAALTLSGVQPEDEAEYYCVLWYSNRWVFGGGTKLTVLHHHHHH |
| 1608 | CDR-H1 of CDH19 65234.001 | artificial | AA | SYYWS |
| 1609 | CDR-H2 of CDH19 65234.001 | artificial | AA | YIYYIGSTNYNPSLKS |
| 1610 | CDR-H3 of CDH19 65234.001 | artificial | AA | DSRYRSGWYDAFDI |
| 1611 | CDR-L1 of CDH19 65234.001 | artificial | AA | RASQSVAGSYLA |
| 1612 | CDR-L2 of CDH19 65234.001 | artificial | AA | GASSRAT |
| 1613 | CDR-L3 of CDH19 65234.001 | artificial | AA | QQYGKSPIT |
| 1614 | VH of CDH19 65234.001 | artificial | NT | CAGGTGCAGCTGCAGGAATCCGGCCCTGGCCTGGTCAAGCCCTCGGACCACTGTCCTGACCTGCACCGTGTCCGGCGGCTCCAT CAACTCCTACTACTGGTCCTGGATCCGGCAGCCTCCGGCCAAGGGCCTGGAATGGATCGGCTACATCTACTACATCGGCTCCACCA ACTACAACCCCAGCCTGAAGTCCAGAGTGACCATCTCCGTGGACACCTCCAAGAACCAGTTCTCCCTGAAGCTGTCTCCGTGACC GCCGCTGACACCGCCGTGTACTACTGCGCCAGAGACTCCCGGTACGACGCTTCGACGACGCTCGACATCTGGGGCCAGGG CACCATGGTCACCGTGTCCTCT |
| 1615 | VH of CDH19 65234.001 | artificial | AA | QVQLQESGPGLVKPSETLSLTCTVSGGSINSYYWSWIRQPPGKGLEWIGYIYYIGSTNYNPSLKSRVTISVDTSKNQFSLKLSSVT AADTALYYCARDSRYRSGWYDAFDIWGQGTMVTVSS |
| 1616 | VL of CDH19 65234.001 | artificial | NT | GATATCGTGCTGACCCAGTCCCCGGCTGTCTCCCTGGCTCCCGGAGAGAGAGCCACCCTGTCCTGCAGAGCCTCCAGTCCGT GGCCGGCTCCTACTTGGCCTGGTATCAGCAGAAGCCCGGCCAGGCCCCTCGGCTGCTGATCTACGGCGCCTCTTCTAGAGCCACCG GCATCCCTGACCGGTTCTCCGGCTCTGGCTCCGGCACCGACTTCACCCTGACCATCAGCCGGCTGGAACCCGAGGACTTCGCCGTG TACTATTGCCAGCAGTACGGCAAGTCCCCCATCACCTTCGGCCAGGGAACCCGGCTGGAAATGAAGTCC |
| 1617 | VL of CDH19 65234.001 | artificial | AA | DIVLTQSPGTLSLSPGERATLSCRASQSVAGSYLAWYQQKPGQAPRLLIYGASSRATGIPDRFSGSGSGTDFTLTISRLEPEDFAV YYCQQYGKSPITFGQGTRLEMKS |
| 1618 | VH-VL of CDH19 65234.001 | artificial | NT | CAGGTGCAGCTGCAGGAATCCGGCCCTGGCCTGGTCAAGCCCTCGGACCACTGTCCTGACCTGCACCGTGTCCGGCGGCTCCAT CAACTCCTACTACTGGTCCTGGATCCGGCAGCCTCCGGCCAAGGGCCTGGAATGGATCGGCTACATCTACTACATCGGCTCCACCA ACTACAACCCCAGCCTGAAGTCCAGAGTGACCATCTCCGTGGACACCTCCAAGAACCAGTTCTCCCTGAAGCTGTCTCCGTGACC GCCGCTGACACCGCCGTGTACTACTGCGCCAGAGACTCCCGGTACGACGCTTCGACGACGCTCGACATCTGGGGCCAGGG CACCATGGTCACCGTGTCCTCAGGCGGCGGAGGCTCTGGCGGAGGTGGAAGCGGCGGAGGTGGCGGATCCGAATATCGTGCTGACCCAGT CCCCGGCACCCTGTCCTGTCCCCGGCGGAGAGGGCACCCTGTCCTGCAGAGCCTCCAGTCCGTGGCCGGCTCCTACCTGGCT TGGTATCAGCAGAAGCCCGGCCAGGCCCCTCGGCTGCTGATCTACGGCGCCTCTTCTAGAGCCACCGGCCATCCCTGACCGGTTCTC |

TABLE VI-continued

| SEQ ID NO. | DESIGNATION | SOURCE | TYPE | SEQUENCE |
|---|---|---|---|---|
| 1619 | VH-VL of CDH19 65234.001 | artificial | AA | CGGCTCTGGCTCCGGCACCGACTTCACCCTGACCATCAGCCGGCTGGAACCCGAGGACTTCGCCGTGTACTATTGCCAGCAGTACG GCAAGTCCCCCATCACCTTCGGCCAGGGAACCCGGCTGGAAATGAAGTCC |
| 1620 | CDH19 65234.001 x I2C | artificial | AA | QVQLQESGPGLVKPSETLSLTCTVSGGSINSYYWSWIRQPPGKGLEWIGYIYYIGSTNYNPSLKSRVTISVDTSKNQFSLKLSSVT AADTALYYCARDSRYRSGWYDAFDIWGQGTMTVSSGGGGSGGGGSGGGGSDIVLTQSPGTLSLSPGERATLSCRASQSVAGSYLA WYQQKPGQAPRLLIYGASSRATGIPDRFSGSGSGTDFTLTISRLEPEDFAVYYCQQYGKSPITFGQGTRLEMKSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1621 | CDR-H1 of CDH19 65234.004 | artificial | AA | SYYWS |
| 1622 | CDR-H2 of CDH19 65234.004 | artificial | AA | YIYYIGSTNYNPSLKS |
| 1623 | CDR-H3 of CDH19 65234.004 | artificial | AA | ESRYRSGWYDAFDI |
| 1624 | CDR-L1 of CDH19 65234.004 | artificial | AA | RASQSVAGSYLA |
| 1625 | CDR-L2 of CDH19 65234.004 | artificial | AA | GASSRAT |
| 1626 | CDR-L3 of CDH19 65234.004 | artificial | AA | QQYGKSPIT |
| 1627 | VH of CDH19 65234.004 | artificial | NT | CAGGTGCAGCTGCAGGAATCCGGCCCTGGCGTCAAGCCCTCCGAGACACTGTCCCTGACCTGTCCGGCGGCTCCAT CAGCTCCTACTACTGGTCCTGGATCCGGCAGCCCCCTGGCAAGGGCCTGGAATGGATCGGCTACATCTACTACATCGGCTCCACCA ACTACAACCCCAGCCTGAAGTCCAGAGTGACCATCTCCGTGGACACCAGTTCTCCCTGAAGCTGTCCTCCGTGACC GCCGCTGACACCGCCCTGTACTACTGCGCCAGAGAGTCCCGGTACAGAGTCCGGGTGGTACGACGCCTTCGACATCTGGGGCCAGGG CACCATGGTCACCGTGTCCTCT |
| 1628 | VH of CDH19 65234.004 | artificial | AA | QVQLQESGPGLVKPSETLSLTCTVSGGSISSYYWSWIRQPPGKGLEWIGYIYYIGSTNYNPSLKSRVTISVDTSKNQFSLKLSSVT AADTALYYCARESRYRSGWYDAFDIWGQGTMTVSS |
| 1629 | VL of CDH19 65234.004 | artificial | NT | GATATCGTGCTGACCCAGTCCCCCGGCACCCTGTCTCTGAGCCCTGGCGAGAGAGCCACCCTGTCCTGCAGAGCCTCTCAGTCCGT GGCCGGCTCCTACCTGGCTTGGTATCAGCAGAAGCCCGGCCAGGCCCCTCGGCTGCTGATCTACGGCGCCTCTTCTAGAGCACCG GCATCCTGACCGGTTCTCCGGCTCCGGCTCCGGCACCGACTTCACCCTGACCATCAGCCGGCTGGAACCCGAGGACTTCGCCGTG TACTATTGCCAGCAGTACGGCAAGTCCCCCATCACCTTCGGCCAGGGAACCCGGCTGGAAATGAAGTCC |

TABLE VI-continued

| SEQ ID NO. | DESIGNATION | SOURCE | TYPE | SEQUENCE |
|---|---|---|---|---|
| 1630 | VL of CDH19 65234.004 | artificial | AA | DIVLTQSPGTLSLSPGERATLSCRASQSVAGSYLAWYQQKPGQAPRLLIYGASSRATGIPDRFSGSGSGTDFTLTISRLEPEDFAV YYCQQYGKSPITFGQGTRLEMKS |
| 1631 | VH-VL of CDH19 65234.004 | artificial | NT | CAGGTGCAGCTGCAGGAATCCGGCCCTGGTCTCAAGCCCTCGGCTCTGCCTGACCTGTCCTGCACCGTGTCCGGCTCCAT CAGCTTCTACTACTGTCCAGGATCCTGGATCGGCAGCCCTGAAGGCCTGGAGTGGATCGGCTACATCTACTACTCGGCTCCACCA ACTACAACCCCAGCCTGAAGTCCAGAGTCACCATCTCCGTGGACACCAGTTCTCCCTGAAGCTGTCTCCGTGACC GCCGCTGACACCGCCGTGTACTACTGCGCCAGAGAGTCCGGATGGTACGATGCCGACTTCGACATCTGGGGACAGG CACCATGGTCACCGTGTCCTCTGGTGGCGGAGGCTCAGGCGGCGGATCCGATATCGTGCTGACCCAGT CCCCGGCACCCTGTCTCTGAGCCCTGGCGAGAGAGCCACCCTGTCTTGCAGAGCCTGCTGCGGCCATCCCTGACCGTTCTC TGGTATCAGCAGAAGCCGGCCAGGCCCCCTCACCTGACTCTACGGCGCTCCAGCGGCTGACCATCAGCCTGTCTAGGCCTGGAACCCTGACCAGCCAGCTCCGCCTGTACTATTGCCAGCAGTACG GCAAGTCCCCATCACCTTCGGCCAGGGAACCCGGCTGGAAATGAAGTCC |
| 1632 | VH-VL of CDH19 65234.004 | artificial | AA | QVQLQESGPGLVKPSETLSLTCTVSGGSISSYYWSWIRQPPGKGLEWIGYIYYIGSTNYNPSLKSRVTISVDTSKNQFSLKLSSVT AADTALYYCARESRYRSGWYDAFDIWGQGTMVTVSSGGGGSGGGGSDIVLTQSPGTLSLSPGERATLSCRASQSVAGSYLA WYQQKPGQAPRLLIYGASSRATGIPDRFSGSGSGTDFTLTISRLEPEDFAVYYCQQYGKSPITFGQGTRLEMKS |
| 1633 | CDH19 65234.004 x I2C | artificial | AA | QVQLQESGPGLVKPSETLSLTCTVSGGSISSYYWSWIRQPPGKGLEWIGYIYYIGSTNYNPSLKSRVTISVDTSKNQFSLKLSSVT AADTALYYCARESRYRSGWYDAFDIWGQGTMVTVSSGGGGSGGGGSDIVLTQSPGTLSLSPGERATLSCRASQSVAGSYLA WYQQKPGQAPRLLIYGASSRATGIPDRFSGSGSGTDFTLTISRLEPEDFAVYYCQQYGKSPITFGQGTRLEMKSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1634 | CDR-H1 of CDH19 65235.005 | artificial | AA | SYFIH |
| 1635 | CDR-H2 of CDH19 65235.005 | artificial | AA | IINPISVSTSYAQKFQG |
| 1636 | CDR-H3 of CDH19 65235.005 | artificial | AA | GGIQLWLHLDY |
| 1637 | CDR-L1 of CDH19 65235.005 | artificial | AA | SGSRSNIGSNFVN |
| 1638 | CDR-L2 of CDH19 65235.005 | artificial | AA | TNNQRPS |
| 1639 | CDR-L3 of CDH19 65235.005 | artificial | AA | ATYDESMQGWV |
| 1640 | VH of CDH19 65235.005 | artificial | NT | CAGGTGCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGGCAGGCTGAATGGATGGGCATCATCAACCCTATCTCCGTGTCCA |

TABLE VI-continued

| SEQ ID NO. | DESIGNATION | SOURCE | TYPE | SEQUENCE |
|---|---|---|---|---|
| 1641 | VH of CDH19 65235.005 | artificial | AA | CCTCCTACGCCCAGAAATTCAGGCGAGAGTGACCATGACCCGGACACCTCCACCGTGACATGGAACTGTCCTCCTG CGGAGCGAGGAGACACCGCCGTGTACTACTGCGCCAGAGGCGGCATCCAGCTGTGGCTGCACCTGGACTATTGGGCCAGGGCACCCT GGTCACCGTGTCCTCT QVQLVQSGAEVKKPGASVKVSCKVSGYTFTSYFIHWVRQAPGQGLEWMGIINPISVSTSYAQKFQGRVTMTRDTSTSTVYMELSSL RSEDTAVYYCARGGIQLWLHLDYWGQGTLVTVSS |
| 1642 | VL of CDH19 65235.005 | artificial | NT | CAGTCTGCCCTGACCCAGCCTCCCTCGTGTCCGGCACACCTGGCTCCAGGCCGTGACCATCTCCTGCTCCGGCTCCAACAT CGGCTCCAACTTGTGAACTGTACCAGCAGTGCCCGGCACCCCCAAGCTGCTGATCTACACACAACCAGCGGCCTCCG GCGTGCCCGACCGGTTCTCTGGCTCCAAGTCTGGCACCTCCGCCTCCCTGGCTGTTCGGCGGAGGACGAGGCCGAC TACTACTGTGCCACCTACGACGAGTCCATGCAGGGCTGGTGTTCGGCGGAGGGACCAAGCTGACCGTGCTGTCC |
| 1643 | VL of CDH19 65235.005 | artificial | AA | QSALTQPPSVTGTPGQRVTISCSGSRSNIGSNFVNWYQQLPGTAPKVLIYTNNQRPSGVPDRFSGSKSGTSASLAISGLQSEDEAD YYCATYDESMQGWVFGGGTKLTVLS |
| 1644 | VH-VL of CDH19 65234.005 | artificial | NT | CAGGTGCAGCTGGTGCAGTCCGGAGCTGAAGTAAAGAAACCTGGCGCCTCCGTGAAGGTGTCCTGCAAGGTGTCCGGCTACACCTT CACCAGCTACTTCATCCACTGGGTCCGACAGGCCCCAGGCCAGGGCCTGGAATGGATGGGCATCAATCCAATCTCCGTGTCCA CCTCCTACGCCCAGAAATTCCAGGGCAGACACCGTGACCGTGACCAGAGACACCTCCACCGTGTACATGGAACTGTCCTCCCTG CGGAGCGAGGACACCGCCGTGTACTACTGCGCCCGGGGCATCCAGCTGTGCTGCACCTGGACTATTGGGGCCAGGGCACCCT GGTCACCGTGTCCTCTGGTGGCGGAGGCTCTGGCGGAGGCGGATCCAGTGCTCCCTGACCCAGCCTCCT CCGTCACCGGACACCTGGCCCAGCCGTGACCATCTCCTGCTCCGGCTCCAACATCGGCTCCAACTTGTGAACTGTAC CAGCAGCTGCCCGGCACCGCCCCCAAGTGCTGATCTACACCAACAACCAGCGGCCTCCGGCGTGCCCGACCGGTTCTCTGGCTC CAAGTCTGGCACCTCCGCCTCCCTGGCCATCTCCGGACTGCAGTCTGAGGACGAGGCCGACTACTACTGTGCCACCTACGAGT CCATGCAGGGCTGGGTGTTCGGCGGAGGGACCAAGCTGACCGTGCTGTCC |
| 1645 | VH-VL of CDH19 65234.005 | artificial | AA | QVQLVQSGAEVKKPGASVKVSCKVSGYTFTSYFIHWVRQAPGQGLEWMGIINPISVSTSYAQKFQGRVTMTRDTSTSTVYMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATYDESMQGWVFGGGTKLTVLS |
| 1646 | CDH19 65234.005 x I2C | artificial | AA | QVQLVQSGAEVKKPGASVKVSCKVSGYTFTSYFIHWVRQAPGQGLEWMGIINPISVSTSYAQKFQGRVTMTRDTSTSTVYMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATYDESMQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1647 | CDR-H1 of CDH19 65235.002 | artificial | AA | SYFIH |
| 1648 | CDR-H2 of CDH19 65235.002 | artificial | AA | IINPISVSTSYAQKFQG |
| 1649 | CDR-H3 of CDH19 65235.002 | artificial | AA | GGIQLWLHLDY |
| 1650 | CDR-L1 of CDH19 65235.002 | artificial | AA | SGSRSNIGSNFVN |

TABLE VI-continued

| SEQ ID NO. | DESIGNATION | SOURCE | TYPE | SEQUENCE |
|---|---|---|---|---|
| 1651 | CDR-L2 of CDH19 65235.002 | artificial | AA | TNNQRPS |
| 1652 | CDR-L3 of CDH19 65235.002 | artificial | AA | ATWDDSMNGWV |
| 1653 | VH of CDH19 65235.002 | artificial | NT | CAGGTGCAGCTGGTGCAGTCTGGGCGCCGAAGTGAAGAAACCTGGCGCTCCGTGAAGGTGTCCTGCAAGGTGTCCGGCTACACCTT CACCAGCTACTTCATCCACTGGGTCCGACAGGCCCCAGGCCAGGGCCTGGAATGGATGGGCATCATCAACCCTATCTCCGTGTCCA CCTCCTACGCCCAGAAATTCCAGGGCAGAGTGACCATGACCCGGGACACCTCCACCGTGTTCATGGAACTGTCCTCCCTG CGGAGCGAGGACACCGCCGTGTACTACTGCGCCAGAGGCATCCAGCTGTGGCTGCACGACTATTGGGGCCAGGGCACCCT GGTCACCGTGTCCTCT |
| 1654 | VH of CDH19 65235.002 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHDYWGQGTLVTVSS |
| 1655 | VL of CDH19 65235.002 | artificial | NT | CAGTCTGCCCTGACCCAGCCTCCCTCGTCACCGGCACACTGGCTGCCCGGACCAGCTGGCTCCAACTTCGTGAACTCCGTGTTCATGAACGGCTGGGTGCCCCAAGGTGCTGATCTACACCAACAACCAGCGCCCCTCCG GCGTGCCCGACCGGTTCTCTGGCTCCAAGTCTGGCACCTCCGCCTCCCTGGCCATCTCCGGCCTGCAGTCCGAGTCCGAGGACGAGGCCGAC TACTACTGTGCCACACTGGGACACGCCATGAACGGCTGGGTGTTCGGCGGAGGCACCAAGCTGACCGTGCTGTCC |
| 1656 | VL of CDH19 65235.002 | artificial | AA | QSALTQPPSVTGTPGQRVTISCSGSRSNIGSNFVNWYQQLPGTAPKVLIYTNNQRPSGVPDRFSGSKSGTSASLAISGLQSEDEAD YYCATWDDSMNGWVFGGGTKLTVLS |
| 1657 | VH-VL of CDH19 65235.002 | artificial | NT | CAGGTGCAGCTGGTGCAGTCTGGCGCCGAAGTGAAGAAACCTGGCGCTCCGTGAAGGTGTCCTGCAAGGTGTCCGGCTACACCTT CACCAGCTACTTCATCCACTGGGTCCGACAGGCCCCAGGCCAGGGCCTGGAATGGATGGGCATCATCAACCCTATCTCCGTGTCCA CCTCCTACGCCCAGAAATTCCAGGGCAGAGTGACCATGACCCGGGACACCTCCACCGTGTTCATGGAACTGTCCTCCCTG CGGAGCGAGGACACCGCCGTGTACTACTGCGCCAGAGGCATCCAGCTGTGGCTGCACGACTATTGGGGCCAGGGCACCCT GGTCACCGTGTCCTCCGGCGGAGGCGGATCTGGCGGAGGTGGAAGCGGAGGCGGAGGATCTGGCGGCTCCAACATGGCTCCAACTTCGTGAACTGGTAC CAGCAGCTGCCCGGCACCGCCCCCAAGGTGCTGATCTACACCAACAACCAGCGCCCCTCCGGCGTGCCCGACCGGTTCTCTGGCTC CAAGTCTGGCACCTCCGCCTCCCTGGCCATCTCCGGCCTGCAGTCCGAGGACGAGGCCGACTACTACTGTGCCACCTGGGACGACT CCATGAACGGCTGGGTGTTCGGCGGAGGCACCAAGCTGACCGTGCTGTCC |
| 1658 | VH-VL of CDH19 65235.002 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDDSMNGWVFGGGTKLTVLS |
| 1659 | CDH19 65235.002 x I2C | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDDSMNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1660 | CDR-H1 of CDH19 65235.003 | artificial | AA | SYFIH |

TABLE VI-continued

| SEQ ID NO. | DESIGNATION | SOURCE | TYPE | SEQUENCE |
|---|---|---|---|---|
| 1661 | CDR-H2 of CDH19 65235.003 | artificial | AA | IINPISVSTSYAQKFQG |
| 1662 | CDR-H3 of CDH19 65235.003 | artificial | AA | GGIQLWLHLDY |
| 1663 | CDR-L1 of CDH19 65235.003 | artificial | AA | SGSRSNIGSNFVN |
| 1664 | CDR-L2 of CDH19 65235.003 | artificial | AA | TNNQRPS |
| 1665 | CDR-L3 of CDH19 65235.003 | artificial | AA | ATWDESMQGWV |
| 1666 | VH of CDH19 65235.003 | artificial | NT | CAGGTCCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGGCCTGGAATGGATGGGAATCATCAACCCTATCTCCGTGTCCA CCTCCTACGCCCAGAAATTCCAGGGCAGAGTGACCATGACCAGGGACACCTCCACCTGCCACCGTCATGGGAACTGTCTCCCTG CGGAGCGAGGACACCGCCGTGTACTACTGCGCCAGAGGCGGCATCCAGCTGTGGCTGCACCTGGACTATTGGGGACAGGGCACCCT GGTCACCGTGTCCTCT |
| 1667 | VH of CDH19 65235.003 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSS |
| 1668 | VL of CDH19 65235.003 | artificial | NT | CAGTCTGCCCTGACCCAGCCTCCCTCGTGACCCTGGCCAGCGCGTGACCATCTCCTGCTCCGGCTCCCGGTCCAACAT CGGCTCCAACTTCGTGAACTGGTACCAGCAGCTGCCCGGCACCGCCCCCAAGCTGCTGATCTACACCAACAACCAGCGCCCTCCG GCGTGCCCGACCGGTTCTCTGGCTCCAAGTCTGGCACCAGCGCCAGCCTGGCCATCTCCGGCCTGCAGTCCGAGGACGAGGCCGAC TACTACTGCGCCACCTGGGACGAGTCCATGCAGGGCTGGGTGTTCGGCGGAGGCACCAAGCTGACCGTGCTGTCC |
| 1669 | VL of CDH19 65235.003 | artificial | AA | QSALTQPPSVTGTPGQRVTISCSGSRSNIGSNFVNWYQQLPGTAPKVLIYTNNQRPSGVPDRFSGSKSGTSASLAISGLQSEDEAD YYCATWDESMQGWVFGGGTKLTVLS |
| 1670 | VH-VL of CDH19 65235.003 | artificial | NT | CAGGTCCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGGCCTGGAATGGATGGGAATCATCAACCCTATCTCCGTGTCCA CCTCCTACGCCCAGAAATTCCAGGGCAGAGTGACCATGACCAGGGACACCTCCACCTGCCACCGTCATGGGAACTGTCTCCCTG CGGAGCGAGGACACCGCCGTGTACTACTGCGCCAGAGGCGGCATCCAGCTGTGGCTGCACCTGGACTATTGGGGCCAGGGCACCCT GGTCACCGTGTCCTCTGGTGGTGGAGGATCTGGCGGAGGTGAAGCGAGGGTGGATCTGGCGGATCTCAGTCGCCCTGACCCAGCCTCCCT CCGTCACCGGACACCTGGCCAGCGCGTGACCATCTCCTGCTCCGGCTCCCGGTCCAACATCGGCTCCAACTTCGTGAACTGGTAC CAGCAGCTGCCCGGCACCGCCCCAAGCTGCTGATCTACACCAACAACCAGCGCCCTCCGAGTCCGGGCCTGTCCGCCCGACCAGCCGCAGCGCCGACTACTGTGCCACCTGGGACGAGT CCATGCAGGGCTGGGTGTTCGGCGGAGGCACCAAGCTGACCGTGCTGTCC |
| 1671 | VH-VL of CDH19 65235.003 | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYYCATWDESMQGWVFGGGTKLTVLS |

TABLE VI-continued

| SEQ ID NO. | DESIGNATION | SOURCE | TYPE | SEQUENCE |
|---|---|---|---|---|
| 1672 | CDH19 65235.003 x I2C | artificial | AA | QVQLVQSGAEVKKPGASVKVSCKVSGYTFTSYFIHWVRQAPGQGLEWMGIINPISVSTSYAQKFQGRVTMTRDTSTSTVFMELSSL RSEDTAVYYCARGIQLWLHLDYWGQGTLVTVSSGGGGSGGGGSGGGGSQSALTQPPSVTGTPGQRVTISCSGSRSNIGSNFVNWY QQLPGTAPKVLIYTNNQRPSGVPDRFSGSKSGTSASLAISGLQSEDEADYCATWDESMQGWVFGGGTKLTVLSGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSGGGGSGGGGSGGGGSQTVVTGEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1673 | CDR-H1 of CDH19 65236.001 | artificial | AA | SYAMN |
| 1674 | CDR-H2 of CDH19 65236.001 | artificial | AA | TISGGGANTYYADSVKG |
| 1675 | CDR-H3 of CDH19 65236.001 | artificial | AA | GGMGGYYYGMDV |
| 1676 | CDR-L1 of CDH19 65236.001 | artificial | AA | RASQSISSNLA |
| 1677 | CDR-L2 of CDH19 65236.001 | artificial | AA | GAFTRAT |
| 1678 | CDR-L3 of CDH19 65236.001 | artificial | AA | QQYNYWPLT |
| 1679 | VH of CDH19 65236.001 | artificial | NT | CAGGTGCAGCTGCTGGAATCCGGCGGAGGACTGGTGCAGCCTGGCGGCTCCCTGAGACTGTCTTGCGCCGCCTCCGGCTTCACCTT CTCCAGCTACGCCATGAACTGGGTCCGACAGGCCCCTGGCAAGGGCCTGGAATGGGTGTCCACCATCAGCGGCGGAGGCCAACA CCTACTACGCCGACTCCGTGAAGGGCCGGTTCACCATCTCCCGGGACAACTCCAAGTCTACCCTGTACCTGCAGATGAACTCCCTG AGAGCCGCCGACACCGCCGTGTACTACTGTGTCCGGCATGGCGGCTACTACTACGGCATGGATGTGTGGGGCCAGGGCAC CACCGTGACCGTGTCTAGC |
| 1680 | VH of CDH19 65236.001 | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAADTAVYHCAKGGMGGYYYGMDVWGQGTTVTVSS |
| 1681 | VL of CDH19 65236.001 | artificial | NT | GAGATCGTGATGACCCAGTCCCCCGTTGACCCTGAGCCTGGCCGAGAGACCGCCACCCTGTCTTGCCGGGCCTCCCAGTCCAT CTCCAGCAACCTGGCCTGGTTCCAGCAGAAGCCCGGCCAGGCCCCTCGGCTGCTGATCTACGGCGCCTTTACCCGGGCCACCGGCA TCCCTGCCAGACTACAACTACTGGCCTCCGGCCCTGACCTTCACCGTGCCACCAAGGTGGAGGCGGCGACCAAGGTGGAAATCAAGTCC TACTACTGCCAGCAGTACAACTACTGGCCTCTGACCTTCGGAGGCGGCGACCAAGGTGGAAATCAAGTCC |
| 1682 | VL of CDH19 65236.001 | artificial | AA | EIVMTQSPVTLSLSLGERATLSCRASQSISSNLAWFQQKPGQAPRLLIYGAFTRATGIPARVSGSGSGTEFTLTISSLQSEDFAVY YCQQYNYWPLTFGGGTKVEIKS |
| 1683 | VH-VL of CDH19 65236.001 | artificial | NT | CAGGTGCAGCTGCTGGAATCCGGCGGAGGACTGGTGCAGCCTGGCGGCTCCCTGAGACTGTCTTGCGCCGCCTCCGGCTTCACCTT CTCCAGCTACGCCATGAACTGGGTCCGACAGGCCCCTGGCAAGGGCCTGGAATGGGTGTCCACCATCAGCGGCGGAGGCCAACA CCTACTACGCCGACTCCGTGAAGGGCCGGTTCACCATCTCCCGGGACAACTCCAAGTCTACCCTGTACCTGCAGATGAACTCCCTG |

TABLE VI-continued

| SEQ ID NO. | DESIGNATION | SOURCE | TYPE | SEQUENCE |
|---|---|---|---|---|
| | | | | AGAGCCCGCCGACACCCGCCGTGTACCACTGTCTGCTAAGGGCGGCTACTACTACGGCATGGACGTCTGGGGCCAAGGGCAC |
| | | | | CACCGTGACCGTCTCTAGCCGAGGCGGAGGATCTGGCGGTGTTGTTTCGCCGGGCTCCGAGGCGCTCCGAGATCGTGATGACCCAGTCCC |
| | | | | CCGTGACCCTGTCCCTGAGCCTGCGGAGAGAGCCACCCTGTCTTGCCGCGCCAGTGAGCATCTCCAGCAACCTGGCTGGTTC |
| | | | | CAGCAGAAGCCCGGCCAGGCCCCTCGGCTGCTGATCTACGGCGCCTTTACCCGAGCCACCGGCATCCCTGCCAGAGTGTCTGGCTC |
| | | | | CGGCTCCGGACACGAGTTCACCCTGACCATCAGCTCCCTGCAGCCCGAGGACTTTGCCGTGTACTACTGCCAGCAGTACAACTACT |
| | | | | GGCCCCTGACCTTCGGAGGCGGCACCAAGGTGGAAATCAAGTCC |
| 1684 | VH-VL of CDH19 65236.001 | artificial | AA | QVQLLESGGGLVQPGGSLRLSCAASGFTFSSYAMNWVRQAPGKGLEWVSTISGGGANTYYADSVKGRFTISRDNSKSTLYLQMNSL |
| | | | | RAADTAVYHCAKGMGGYYYGMDVWGQGTTVTVSSGGGGSGGGGSGGGGSEIVMTQSPVTLSLSLGERATLSCRASQSISSNLAWF |
| | | | | QQKPGQAPRLLIYGAFTRATGIPARVSGSGSGTEFTLTISLQSEDFAVYYCQQYNYWPLTFGGGTKVEIKS |
| 1685 | CDH19 65236.001 x I2C | artificial | AA | QVQLLESGGGLVQPGGSLRLSCAASGFTFSSYAMNWVRQAPGKGLEWVSTISGGGANTYYADSVKGRFTISRDNSKSTLYLQMNSL |
| | | | | RAADTAVYHCAKGMGGYYYGMDVWGQGTTVTVSSGGGGSGGGGSGGGGSEIVMTQSPVTLSLSLGERATLSCRASQSISSNLAWF |
| | | | | QQKPGQAPRLLIYGAFTRATGIPARVSGSGSGTEFTLTISLQSEDFAVYYCQQYNYWPLTFGGGTKVEIKSGGGGSEVQLVESGG |
| | | | | GLVQPGGSLKLSCAASGFTFNKYAMNWVRQAPGKGLEWVARIRSKYNNYATYYADSVKDRFTISRDDSKNTAYLQMNNLKTEDTAV |
| | | | | YYCVRHGNFGNSYISYWAYWGQGTLVTVSSGGGGSGGGGSGGGGSQTVVTQEPSLTVSPGGTVLTCGSSTGAVTSGNYPNWVQQK |
| | | | | PGQAPRGLIGGTKFLAPGTPARFSGSLLGGKAALTLSGVQPEDEAEYYCVLWYSNRWVFGGGTKLTVLHHHHHH |
| 1686 | CDR-H1 of CDH19 65236.007 | artificial | AA | SYAMN |
| 1687 | CDR-H2 of CDH19 65236.007 | artificial | AA | TISGGGANTYYAESVKG |
| 1688 | CDR-H3 of CDH19 65236.007 | artificial | AA | GGMGGYYYGMDV |
| 1689 | CDR-L1 of CDH19 65236.007 | artificial | AA | RASQSISSNLA |
| 1690 | CDR-L2 of CDH19 65236.007 | artificial | AA | GAFTRAT |
| 1691 | CDR-L3 of CDH19 65236.007 | artificial | AA | QQYNYWPLT |
| 1692 | VH of CDH19 65236.007 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT |
| | | | | CTCCAGCTACGCCATGAACTGGGTCCGACAGGCCCCTGGCAAGGGCCTGGAATGGGTGTCCACCATCAGCGGCGGAGGCGCCAACA |
| | | | | CCTACTACGCCGACTCCGTGAAGGGCCGGTTCACCATCTCCTCCGACAACTCCAAGTCCACCCTGTACCTGCAGATGAACTCCCTG |
| | | | | AGAGCCGAGGACACCGCCGTGTACTACTGTGCTAAGGGCGGCTACTACTACGGCATGGATGTGTGGGGCCAGGGCAC |
| | | | | CCTCGTGACCGTGTCTAGC |
| 1693 | VH of CDH19 65236.007 | artificial | AA | QVQLLESGGGLVQPGGSLRLSCAASGFTFSSYAMNWVRQAPGKGLEWVSTISGGGANTYYAESVKGRFTISSDNSKSTLYLQMNSL |
| | | | | RAEDTAVYHCAKGGMGGYYYGMDVWGQGTLVTVSS |

TABLE VI-continued

| SEQ ID NO. | DESIGNATION | SOURCE | TYPE | SEQUENCE |
|---|---|---|---|---|
| 1694 | VL of CDH19 65236.007 | artificial | NT | GAGATCGTGATGACCCAGTCCCCGTGACCCTGTCCCTGAGCCTGGGCGAGAGAGCCACCCTGTCTTGCCGGGCCTCCCAGTCAT CTCCAGCAACCTGGCTGCTTCCAGCAGAAGCCCGGCCAGGCCCCTCGGCTGCTGATCTACGGCGCCTTTACCCGGGCCACCGGCA TCCCTGCCAGATTCTCTGGCTCCGGCTCCGGCACCGAGTTCACCCTGACCATCAGCTCCCTGCAGCCCGAGGACTTTGCCGTGTAC TACTGCCAGCAGTACAACTACTGGCCCCTGACCTTCGGAGGCGGCACCAAGGTGGAAATCAAGTCC |
| 1695 | VL of CDH19 65236.007 | artificial | AA | EIVMTQSPVTLSLSLGERATLSCRASQSISSNLAWFQQKPGQAPRLLIYGAFTRATGIPARFSGSGSGTEFTLTISSLEPEDFAVY YCQQYNYWPLTFGGGTKVEIKS |
| 1696 | VH-VL of CDH19 65236.007 | artificial | NT | CAGGTGCAGCTGCTGGAATCCGGCGGAGGACTGGTGCAGCCCGGCGGATCCCTGAGACTGTCTTGCGCCGCCTCCGGCTTCACCTT CTCCAGCTACGCCATGAACTGGGTCCGACAGGCCCCTGGCAAGGGCCTGGAATGGGTGTCCACCATCAGCGGCGGAGGCAACA CCTACTACGCCGACTCCGTGAAGGGCCGGTTCACCATCTCCCGGGACAACTCCAAGTCCACCCTGTACCTGCAGATGAACTCCCTG AGAGCCGAGGACACCGCCGTGTACTACTGTGCTAAGGGCGTGCTACTACTACGGCATGGATGTGTGGGGCCAGGGCAC CCTCGTGACCGTGTCTAGCGGAGGCGGAGGATCTGGCGGTGGTTCTGGCGGAGGCGGCTCCGAGATCGTGATGACCCAGTCC CCCGTGACCCTGTCCCTGAGCCTGGGCGAGAGAGCCACCCTGTCTTGCCGGGCCTCCCAGTCCATCTCCAGCAACCTGGCTTGGTTC CAGCAGAAGCCCGGCCAGGCCCCTCGGCTGCTGATCTACGGCGCCTTTACCCGGGCCACCGGCATCCCTGCCCAGATTCTCTGGCTC CGGCTCCGGCACCGAGTTCACCCTGACCATCAGCTCCCTGCAGCCCGAGGACTTTGCCGTGTACTACTGCCAGCAGTACAACTACT GGCCCCTGACCTTCGGAGGCGGCACCAAGGTGGAAATCAAGTCC |
| 1697 | VH-VL of CDH19 65236.007 | artificial | AA | QVQLLESGGGLVQPGGSLRLSCAASGFTFSSYAMNWVRQAPGKGLEWVSTISGGANTYYAESVKGRFTISSDNSKSTLYLQMNSL RAEDTAVYHCAKGGMGGYYYGMDVWGQGTLVTVSSGGGGSGGGGSGGGGSEIVMTQSPVTLSLSLGERATLSCRASQSISSNLAWF QQKPGQAPRLLIYGAFTRATGIPARFSGSGSGTEFTLTISSLEPEDFAVYYCQQYNYWPLTFGGGTKVEIKS |
| 1698 | CDH19 65236.007 x I2C | artificial | AA | QVQLLESGGGLVQPGGSLRLSCAASGFTFSSYAMNWVRQAPGKGLEWVSTISGGANTYYAESVKGRFTISSDNSKSTLYLQMNSL RAEDTAVYHCAKGGMGGYYYGMDVWGQGTLVTVSSGGGGSGGGGSGGGGSEIVMTQSPVTLSLSLGERATLSCRASQSISSNLAWF QQKPGQAPRLLIYGAFTRATGIPARFSGSGSGTEFTLTISSLEPEDFAVYYCQQYNYWPLTFGGGTKVEIKSGGGGSEVQLVESGG GLVQPGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1699 | CDR-H1 of CDH19 65236.009 | artificial | AA | SYAMN |
| 1700 | CDR-H2 of CDH19 65236.009 | artificial | AA | TISGGGANTYYADSVKG |
| 1701 | CDR-H3 of CDH19 65236.009 | artificial | AA | GGMGGYYYGMDV |
| 1702 | CDR-L1 of CDH19 65236.009 | artificial | AA | RASQSISSNLA |
| 1703 | CDR-L2 of CDH19 65236.009 | artificial | AA | GAFTRAT |

TABLE VI-continued

| SEQ ID NO. | DESIGNATION | SOURCE | TYPE | SEQUENCE |
|---|---|---|---|---|
| 1704 | CDR-L3 of CDH19 65236.009 | artificial | AA | QQYNYWPLT |
| 1705 | VH of CDH19 65236.009 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT CTCCAGCTACGCCATGAACTGGGTCCGACAGGCCCCTGGCAAGGGCCTGGAATGGGTGTCCACCATCAGCGGCGGAGGCGCCAACA CCTACTACGCCGACTCCGTGAAGGGCCGGTTCACCATCTCCCGGGACAACTCCAAGTCCACCCTGTACCTGCAGATGAACTCCCTG AGAGCCGAGGACACCGCCGTGTACTACTGTGCTAAGGGCGGCTACTACTACGGCATGGATGTGTGGGGCCAGGGCAC CACCGTGACCGTGTCTAGC |
| 1706 | VH of CDH19 65236.009 | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAEDTAVYYCAKGGYYYGMDVWGQGTTVTVSS |
| 1707 | VL of CDH19 65236.009 | artificial | NT | GAGATCGTGATGACCCAGTCCCCCGTGACCCTGTCCCTGGGCGAGAGACCACCCTGTCTTGCCGGGCCTCCCAGTCCAT CTCCAGCAACTGGCTGGCTTGGTTCCAGCAGAAGCCCGGCCAGGCCCCTCGGCTGCTGATCTACGGCGCCTTTACCCGGCCACCGGCA TCCCTGCCAGATGTCTGGCTCCGGCACCGAGTTCACCCTGACCATCAGCTCCCTGCAGTCCGAGGACTTTGCCGTGTAC TACTGCCAGCAGTACAACTACTGGCCCCTGACCTTCGGAGGCGGCACCAAGGTGGAAATCAAGTCC |
| 1708 | VL of CDH19 65236.009 | artificial | AA | EIVMTQSPVTLSLSLGERATLSCRASQSISSNLAWFQQKPGQAPRLLIYGAFTRATGIPARVSGSGSGTEFTLTISSLQSEDFAVY YCQQYNYWPLTFGGGTKVEIKS |
| 1709 | VH-VL of CDH19 65236.009 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT CTCCAGCTACGCCATGAACTGGGTCCGACAGGCCCCTGGCAAGGGCCTGGAATGGGTGTCCACCATCAGCGGCGGAGGCGCCAACA CCTACTACGCCGACTCCGTTCACCATCTCCCGGACAACTCCAAGTCCACCCTGTACCTGCAGATGAACTCCCTG CACCGTGACCGTGTCTAGCGGAGGCGGAGGATCTGGCGGTGGTTCTGCGGGCGGCTCCGGAGATCGTGATGACCCAGTCCC CGGTGACCCTGTCCCTGGGCGAGAGACCGCCCTGTCTTGCCGGGCCTCCATCTCCAGCAACTGGCTGGCCTGGTTC CAGCAGAAGCCCGGCCAGGCCCCTCGGCTGCTGATCTACGGCGCCTTTACCCGGCCACCGGCATCCTGCCAGTGTCTGGCTC CGGCACCGAGTTCACCCTGACCATCAGCTCCCTGCAGTCCGAGGACTTTGCCGTGTACTACTGCCAGCAGTACAACTACT GGCCCCTGACCTTCGGAGGCGGCACCAAGGTGGAAATCAAGTCC |
| 1710 | VH-VL of CDH19 65236.009 | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAEDTAVYYCAKGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIKS |
| 1711 | CDH19 65236.009 x I2C | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAEDTAVYYCAKGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1712 | CDR-H1 of CDH19 65236.010 | artificial | AA | SYAMN |
| 1713 | CDR-H2 of CDH19 65236.010 | artificial | AA | TISGGGANTYYADSVKG |

TABLE VI-continued

| SEQ ID NO. | DESIGNATION | SOURCE | TYPE | SEQUENCE |
|---|---|---|---|---|
| 1714 | CDR-H3 of CDH19 65236.010 | artificial | AA | GGMGGYYYGMDV |
| 1715 | CDR-L1 of CDH19 65236.010 | artificial | AA | RASQSISSNLA |
| 1716 | CDR-L2 of CDH19 65236.010 | artificial | AA | GAFTRAT |
| 1717 | CDR-L3 of CDH19 65236.010 | artificial | AA | QQYNYWPLT |
| 1718 | VH of CDH19 65236.010 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT CTCCAGCTACGCCGACTCCGTGAAGGGCCGGTTCACCATCTCCCGGACAACTCCAAGTGCCACCTGTACCTGCAAGATGAACTCCCTG CCTACTACGCCGAGGAGTCCGGTTCACCATCTCCCGGACAACTCCAAGTGCCACCTGTACCTGCAAGATGAACTCCCTG AGAGCCGAGGACACCGCCGTGTACCACTGTGCTAAGGGCGGCATGGGCGGCTACTACTACGGCATGGATGTGTGGGGCCAGGGCAC CACCGTGACCGTGTCTAGC |
| 1719 | VH of CDH19 65236.010 | artificial | AA | QVQLLESGGGLVQPGGSLRLSCAASGFTFSSYAMNWVRQAPGKGLEWVSTISGGANTYYADSVKGRFTISRDNSKSTLYLQMNSL RAEDTAVYHCAKGGMGGYYYGMDVWGQGTTVTVSS |
| 1720 | VL of CDH19 65236.010 | artificial | NT | GAGATCGTGATGACCCAGTCCCCCGTCACTCTGTCTCTGCCGGCCACCGGAGAGAGGCCACCCTGTCTTGCCGGGCCTCCCAGTCCAT CTCCAGCAACCTGGCCTGGTTCCAGCAGAAGCCCGGCCAGGCCCCTCGGCTGCTGATCTACGGCGCCTTTACCCGGGCCACCGGCA TCCCTGCCAGATGCTTCTGGCTCCGGCTCCGGCACCGAGTTCACCCTGACCATCAGCTCCCTGGAGCCCGAGGACTTTGCCGTGTAC TACTGCCAGCAGTACAACTACTGGCCCCTGACCTTCGGCCCTGGGACCAAGGTGGAAATCAAGTCC |
| 1721 | VL of CDH19 65236.010 | artificial | AA | EIVMTQSPVTLSLSPGERATLSCRASQSISSNLAWFQQKPGQAPRLLIYGAFTRATGIPARVSGSGSGTEFTLTISSLEPEDFAVY YCQQYNYWPLTFGPGTKVEIKS |
| 1722 | VH-VL of CDH19 65236.010 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT CTCCAGCTACGCCATGAACTGGGTCCGACAGGCCCCTGGCAAGGGCCTGGAATGGGTCTCCACCATCTCCGGCGAGGCCAACA CCTACTACGCCGACTCCGTGAAGGGCCGGTTCACCATCTCCCGGACAACTCCAAGTGCCACCTGTACCTGCAAGATGAACTCCCTG AGAGCCGAGGACACCGCCGTGTACCACTGTGCTAAGGGCGGCATGGGCGGCTACTACTACGGCATGGATGTGTGGGGCCAGGGCAC CACCGTGACCGTGTCTAGCGGAGGCGGAGGATCTGGCGGTGGTTCTGGCGGAGGCGGCTCAGGCGGAGGATCTGATGACCCAGTCC CCCGTGACCCTGTCTAGCCCGGCCGAGGCCCTGGCTCCTGCCGGGCCTCCCAGTCCATCTCCAGCAACCTGGCGTGGTTC CAGCAGAAGCCGGCCAGGCCCTGGCTCCTGCCGGGCCTCCCAGGTCCACCGGCATCCCTGCCAGATGCTTCTGGCTCCGGCTCCGGCACCGAGTCTCAGCTC CCCGTGACCCTGACCATCAGCTCCCTGAGCCCCGAGGACTTTGCCGTGTACTACTGCCAGCAGTACAACTACT GGCCCCTGACCTTCGGAGGCCGGACCAAGGTGGAAATCAAGTCC |
| 1723 | VH-VL of CDH19 65236.010 | artificial | AA | QVQLLESGGGLVQPGGSLRLSCAASGFTFSSYAMNWVRQAPGKGLEWVSTISGGANTYYADSVKGRFTISRDNSKSTLYLQMNSL RAEDTAVYHCAKGGMGGYYYGMDVWGQGTTVTVSSGGGGSGGGGSGGGGSEIVMTQSPVTLSLSPGERATLSCRASQSISSNLAWF QQKPGQAPRLLIYGAFTRATGIPARVSGSGSGTEFTLTISSLEPEDFAVYYCQQYNYWPLTFGGGTKVEIKS |
| 1724 | CDH19 65236.010 x I2C | artificial | AA | QVQLLESGGGLVQPGGSLRLSCAASGFTFSSYAMNWVRQAPGKGLEWVSTISGGANTYYADSVKGRFTISRDNSKSTLYLQMNSL RAEDTAVYHCAKGGMGGYYYGMDVWGQGTTVTVSSGGGGSGGGGSGGGGSEIVMTQSPVTLSLSPGERATLSCRASQSISSNLAWF QQKPGQAPRLLIYGAFTRATGIPARVSGSGSGTEFTLTISSLEPEDFAVYYCQQYNYWPLTFGGGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV |

TABLE VI-continued

| SEQ ID NO. | DESIGNATION | SOURCE | TYPE | SEQUENCE |
|---|---|---|---|---|
| | | | | YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1725 | CDR-H1 of CDH19 65236.011 | artificial | AA | SYAMN |
| 1726 | CDR-H2 of CDH19 65236.011 | artificial | AA | TISGGANTYYADSVKG |
| 1727 | CDR-H3 of CDH19 65236.011 | artificial | AA | GGMGGYYYGMDV |
| 1728 | CDR-L1 of CDH19 65236.011 | artificial | AA | RASQSISSNLA |
| 1729 | CDR-L2 of CDH19 65236.011 | artificial | AA | GAFTRAT |
| 1730 | CDR-L3 of CDH19 65236.011 | artificial | AA | QQYNYWPLT |
| 1731 | VH of CDH19 65236.011 | artificial | NT | CAGGTGCAGCTGCTGGAATCCGGCGGAGGACTGGTCCAGCCTGGCGGCTCCGGCTCTTGCGCCGGCTCTGGCTTCACCTT CTCCAGCTACGCCATGAACTGGGTCCGACAGGCCCCTGGACAGGCGTCCAACCGCCAAACCCTTGTCCACCATCTCCGGCGGC AGCCTACGCCGACTCCGTGAAGGGCCGGTTCACCATCTCCCGGCGACAACTCCAAGTCACCCTGTACCTGCAGATGAACTCCCTG AGAGCCGAGGACACCGCCGTGTACTACTGTGCTAAGGGCGGCATGGGCGGCTACTACTACGGCATGGATGTGTGGGGCCAGGGCAC CACCGTGACCGTGTCTAGC |
| 1732 | VH of CDH19 65236.011 | artificial | AA | QVQLLESGGGLVQPGGSLRLSCAASGFTFSSYAMNWVRQAPGKGLEWVSTISGGANTYYADSVKGRFTISRDNSKSTLYLQMNSL RAEDTAVYHCAKGGMGGYYYGMDVWGQGTTVTVSS |
| 1733 | VL of CDH19 65236.011 | artificial | NT | GAGATCGTGATGACCCAGTCCCCCGTGACCCTGTCTCTGAGCCCTGGCGAGAGAGCCACCCTGTCTTGTCGCGCCTCCCAGTCCAT CTCCAGCAACCTGGCCTGGTTCCAGCAGAAGCCCGGACAGGCCCCGGTGTGTCTGATCTACGGCGCCTTTACCCGGGCCACCGGCA TCCCTGCCAGATTCTCTGGCTCTCCGGCTCCGGCACCGAGTTCACCCTGACCATCAGCTCCCTGGAGCCCGAGGACTTTGCCGTGTAC TACTGCCAGCAGTACAACTACTGGCCCCTGACCTTCGGAGGCGGCACCAAGGTGGAAATCAAGTCC |
| 1734 | VL of CDH19 65236.011 | artificial | AA | EIVMTQSPVTLSLSPGERATLSCRASQSISSNLAWFQQKPGQAPRLLIYGAFTRATGIPARFSGSGSGTEFTLTISSLEPEDFAVY YCQQYNYWPLTFGGGTKVEIKS |
| 1735 | VH-VL of CDH19 65236.011 | artificial | NT | CAGGTGCAGCTGCTGGAATCCGGCGGAGGACTGGTCCAGCCTGGCGGCTCCCGGCTCTTGCGCCGGCTCTGGCTTCACCTT CTCCAGCTACGCCATGAACTGGGTCCGACAGGCCCCTGGACAGGCGTCCAACCGCCAACA CCTACTACGCCGACTCCGTGAAGGGCCGGTTCACCATCTCCCGGCGACAACTCCAAGTCACCCTGTACCTGCAGATGAACTCCTG AGAGCCGAGGACACCGCCGTGTACTACTGTGCTAAGGGCGGCATGGGCGGCTACTACTACGGCATGGATGTGTGGGGCCAGGGCAC CGTGACCGTGTCTAGCGGAGGCGGAGGATCTGGCGGAGGCGGCTCTGGCGGCGGAGGCTCCCAGTCATCTCCAGCAACCTGGCCTGGTTC CGTGACCCTGTCTCTGAGCCCTGGCGAGAGAGCCACCCTGTCTTGTCGCGCCTCCCAGTCCATCTCCAGCAACCTGGCCTGGTTC CAGCAGAAGCCCGGACAGGCCCCCTGGCTGCTGATCTACGGCGCCTTTACCCGGCAGCATCCCTGCCAGATTCTCTGGCTC |

TABLE VI-continued

| SEQ ID NO. | DESIGNATION | SOURCE | TYPE | SEQUENCE |
|---|---|---|---|---|
| 1736 | VH-VL of CDH19 65236.011 | artificial | AA | CGGCTCCGGACACCGAGTTCACCCTGACCATCAGCTCCCTGGAGCCCGAGGACTTTGCCGTGTACTACTGCCAGCAGTACAACTACTGGCCCCTGACCTTCGGAGGCGGCACCAAGGTGGAAATCAAGTCC |
| 1737 | CDH19 65236.011 x I2C | artificial | AA | QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS |
|  |  |  |  | QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLRLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1738 | CDR-H1 of CDH19 65236.012 | artificial | AA | SYAMN |
| 1739 | CDR-H2 of CDH19 65236.012 | artificial | AA | TISGGGANTYYAESVKG |
| 1740 | CDR-H3 of CDH19 65236.012 | artificial | AA | GGMGGYYYGMDV |
| 1741 | CDR-L1 of CDH19 65236.012 | artificial | AA | RASQSISSNLA |
| 1742 | CDR-L2 of CDH19 65236.012 | artificial | AA | GAFTRAT |
| 1743 | CDR-L3 of CDH19 65236.012 | artificial | AA | QQYNYWPLT |
| 1744 | VH of CDH19 65236.012 | artificial | NT | CAGGTGCAGCTGCTGGAATCCGGCGGAGGACTGGTCCAGCCTGGCGGCTCCCTGAGACTGTCTTGCGCCGCCTCCGGCTTCACCTTCTCCAGCTACGCCATGAACTGGGTCCGACAGGCCCCTGGAAAGGGCCTGGAATGGGTGTCCACCATCAGCGGCGGAGGCGCCAACACCTACTACGCCGAGTCCGTGAAGGGCCGGTTCACCATCTCCCGCGACAACTCCAAGTCCACCCTGTACCTGCAGATGAACTCCCTGAGAGCCGAGGACACCGCCGTGTACCACTGTGCTAAGGGCGGCATGGGCGGCTACTACTACGGCATGGATGTGTGGGGCCAGGGCACCACCGTGACCGTGTCTAGC |
| 1745 | VH of CDH19 65236.012 | artificial | AA | QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGMGGYYYGMDVWGQGTTVTVSS |
| 1746 | VL of CDH19 65236.012 | artificial | NT | GAGATCGTGATGACCCAGTCCCCCGTGACCCTGTCCCTGAGCCTGGGCGAGAGAGCCACCCTGTCTTGCCGGGCTCCCAGTCCATTCCCAGCAACCTGGCCTGGTTCCAGCAGAAGCCCGGCCAGGCCCCTCGGCTGCTGATCTACGGCGCCTTTACCCGGGCCACCGGCATCCCTGCCAGATTCTCTGGCTCCGGCTCCGGCACCGAGTTCACCCTGACCATCAGCTCCCTGGAGCCCGAGGACTTTGCCGTGTACTACTGCCAGCAGTACAACTACTGGCCCCTGACCTTCGGAGGCGGCACCAAGGTGGAAATCAAGTCC |

TABLE VI-continued

| SEQ ID NO. | DESIGNATION | SOURCE | TYPE | SEQUENCE |
|---|---|---|---|---|
| 1747 | VL of CDH19 65236.012 | artificial | AA | EIVMTQSPVTLSLSLGERATLSCRASQSISSNLAWFQQKPGQAPRLLIYGAFTRATGIPARFSGSGSGTEFTLTISSLEPEDFAVY YCQQYNYWPLTFGGGTKVEIKS |
| 1748 | VH-VL of CDH19 65236.012 | artificial | NT | CAGGTGCAGCTGCTGGAATCCGGCGGAGGACTGGTGCAGCCTGGCGGCTCCCTGAGACTGTCTTGCGCCGCTCCGGCTTCACCTT CTCCAGCTACGCCGCCATGAACTGGGTCCGACAGGCCCCTGGCAAGGGCCTGGAATGGGTCTCCACCATCAGCGGCGAGGCGCCAACA CCTACTACGCCGACAGCGTCCGTGAAGGGCCGGTTCACCATCTCCCGCGACAACTCCAAGTCCACTACTACGCCCTGTACCTGCAGATGAACTCCCTG AGAGCCGAGGACACCGCCGTGTACTACTGTGCTAAGGGCGTGTTCTGCGGCGAGATCGTGATGGACCCAGTCCAGTCC ACCGTGACCGTCTAGCGAGGCGGAGGATCCGGAGGAGGCCCACCCTGTCTGCCGGCCGGTGGTTCTGGCGGCGGAGGAAGCTCCGGGGGCGGAGGCTCCGGGGGCGGAGGCTCCGGGGGCGGAGGC CCGTGACCCTGTCCCTGGGCCTGGAAGAGCTGCTGAGGAGAGCGCCCTGCCGCCGTGATCTACGCGCTTTACCCGGCCACCGGCATCCCTGCCCAGATTCTCTGGCTCTGCCCACCCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCTGCCCACCT |
| 1749 | VH-VL of CDH19 65236.012 | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAEDTAVYHCAKGGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARFSGSGSGTEFLTISSLEPEDFAVYYCQQYNYWPLTFGGGTKVEIKS |
| 1750 | CDH19 65236.012 × I2C | artificial | AA | QVQLLESGGGLVQPGGSLRLSCAASGFTFSSYAMNWVRQAPGKGLEWVSTISGGGANTYYADSVKGRFTISRDNSKSTLYLQMNSL RAEDTAVYHCAKGGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARFSGSGSGTEFLTISSLEPEDFAVYYCQQYNYWPLTFGGGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1751 | CDR-H1 of CDH19 65236.013 | artificial | AA | SYAMN |
| 1752 | CDR-H2 of CDH19 65236.013 | artificial | AA | TISGGGANTYYADSVKG |
| 1753 | CDR-H3 of CDH19 65236.013 | artificial | AA | GGMGGYYYGMDV |
| 1754 | CDR-L1 of CDH19 65236.013 | artificial | AA | RASQSISSNLA |
| 1755 | CDR-L2 of CDH19 65236.013 | artificial | AA | GAFTRAT |
| 1756 | CDR-L3 of CDH19 65236.013 | artificial | AA | QQYNYWPLT |
| 1757 | VH of CDH19 65236.013 | artificial | NT | CAGGTGCAGCTGCTGGAATCCGGCGGAGGACTGGTCAGCCTGGCGGCTCCCTGAGACTGTCTTGCGCCGCTCCGGCTTCACCTT CTCCAGTCAGTACGCCATGAACTGGGTCCACAGGCCCCTGGCAAGGGCCTGGAATGGGTGTCCACCATCAGCGGCGGAGGCGCCAACA |

TABLE VI-continued

| SEQ ID NO. | DESIGNATION | SOURCE | TYPE | SEQUENCE |
|---|---|---|---|---|
| | | | | CCTACTACGCCGACTCCGTGAAGGGCCGGTTCACCATCTCCCGCGACAACTCCAAGTCCACCCTGTACCTGCAGATGAACTCCCTG AGAGCCGCCGACACCGCCGTGTACTACTGTGCTAAGGGCGGCATGGGCGGCTACTACTACGGCATGGATGTGTGGGGCCAGGGCAC CACCGTGACCGTGTCTAGC |
| 1758 | VH of CDH19 65236.013 | artificial | AA | QVQLLESGGGLVQPGGSLRLSCAASGFTFSSYAMNWVRQAPGKGLEWVSTISGGANTYYADSVKGRFTISRDNSKSTLYLQMNSL RAADTAVYYCAKGGMGGYYYGMDVWGQGTTVTVSS |
| 1759 | VL of CDH19 65236.013 | artificial | NT | GAGATCGTGATGACCCAGTCCCCCGTGACCCTGTCCCTGAGCCCTGGCGAGAGAGCCACCCTGTCTTGCCGGGCCTCCCAGTCCAT CTCCAGCAACCTGGCTTGGTTCCAGCAGAAGCCCGGCCAGGCCCCTAGGCTGCTGATCTACGGCGCCTTACCCGGCCACCGGCA TCCCTGCCAGAGTGTCTGGCTCCGGCTCCGGCACCGAGTTCACCCTGACCATCAGCTCCCTGCAGTCCGAGGACTTTGCCGTGTAC TACTGCCAGCAGTACAACTACTGGCCCCTGACCTTCGGAGGCGGAACCAAGGTGGAAATCAAGTCC |
| 1760 | VL of CDH19 65236.013 | artificial | AA | EIVMTQSPVTLSLSLGERATLSCRASQSISSNLAWFQQKPGQAPRLLIYGAFTRATGIPARVSGSGSGTEFTLTISSLQSEDFAVY YCQQYNYWPLTFGGGTKVEIKS |
| 1761 | VH-VL of CDH19 65236.013 | artificial | NT | CAGGTCCAGCTGCTCGAATCCGGCGGAGGACTGGTCCAGCCTGGCGGCTCTCTGAGACTGTCTTGCGCCGCCTCCGGCTTCACCTT CTCCAGCTACGCCATGAACTGGGTCCGACAGGCCCCTGGCAAGGGCCTGGAATGGGTGTCCACCATCAGCGGCGGAGCCAACA CCTACTACGCCGACTCCGTGAAGGGCCGGTTCACCATCTCCCGCGACAACTCCAAGTCCACCCTGTACCTGCAGATGAACTCCCTG AGAGCCGCCGACACCGCCGTGTACTACTGTGCTAAGGGCGGCATGGGCGGCTACTACTACGGCATGGATGTGTGGGGCCAGGGCAC CACCGTGACCGTGTCTCCCTCCGGCGGAGGCGGATCTGGCGGTGGTTCTGGCGGAGGCGGCAGCGGAGGCGGCGGATCGTGATGACCCAG TCCCCCGTGACCCTGTCTCTGAGCCCTGGCGAGAGAGCCACCCTGTCTTGCCGGGCCTCCCAGTCCATCTCCAGCAACCTGGCCTGGTTC CAGCAGAAGCCCGGCCAGGCCCCTAGGCTGCTGATCTACGGCGCCTTTACCCGGGCCACCGGCATCCCTGCCAGAGTGTCTGGCTC CGGCTCCGGCACCGAGTTCACCCTGACCATCAGCTCCCTGCAGTCCGAGGACTTTGCCGTGTACTACTGCCAGCAGTACAACTACT GGCCCCTGACCTTCGGAGGCGGCACCAAGGTGGAAATCAAGTCC |
| 1762 | VH-VL of CDH19 65236.013 | artificial | AA | QVQLLESGGGLVQPGGSLRLSCAASGFTFSSYAMNWVRQAPGKGLEWVSTISGGANTYYADSVKGRFTISRDNSKSTLYLQMNSL RAADTAVYYCAKGGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIKS |
| 1763 | CDH19 65236.013 x I2C | artificial | AA | QVQLLESGGGLVQPGGSLRLSCAASGFTFSSYAMNWVRQAPGKGLEWVSTISGGANTYYADSVKGRFTISRDNSKSTLYLQMNSL RAADTAVYYCAKGGMGGYYYGMDVWGQGTTVTVSSGGGGSGGGGSGGGGSEIVMTQSPVTLSLSLGERATLSCRASQSISSNLAWF QQKPGQAPRLLIYGAFTRATGIPARVSGSGSGTEFTLTISSLQSEDFAVYYCQQYNYWPLTFGGGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1764 | CDR-H1 of CDH19 65236.014 | artificial | AA | SYAMN |
| 1765 | CDR-H2 of CDH19 65236.014 | artificial | AA | TISGGGANTYYAESVKG |
| 1766 | CDR-H3 of CDH19 65236.014 | artificial | AA | GGMGGYYYGMDV |
| 1767 | CDR-L1 of CDH19 65236.014 | artificial | AA | RASQSISSNLA |

TABLE VI-continued

| SEQ ID NO. | DESIGNATION | SOURCE | TYPE | SEQUENCE |
|---|---|---|---|---|
| 1768 | CDR-L2 of CDH19 65236.014 | artificial | AA | GAFTRAT |
| 1769 | CDR-L3 of CDH19 65236.014 | artificial | AA | QQYNYWPLT |
| 1770 | VH of CDH19 65236.014 | artificial | NT | CAGGTGCAGCTGCTGGAATCCGGCGGAGGACTGGTCCAGCCTGGCGGCTCCCTGAGACTGTCTTGCGCCGCTTCCGGCTTCACCTTCTCCAGCTACGCCATGAACTGGGTCCGACAGGCCCCTGGCAAGGGCCTGGAATGGGTGTCCACCATCAGCGGCGAGGCGCAACACCTACTACGCCGAGTCCGTGAAGGGCCGGTTCACCATCTCCCGGGACAACTCCAAGTCCACCCTGTACCTGCAGATGAACTCCCTGAGAGCCGAGGACACCGCCGTGTACTACTGTGCTAAGGGCGGCTACTACTACGGCATGGATGTGTGGGGCCAGGGCACCCTCGTGACCGTGTCTAGC |
| 1771 | VH of CDH19 65236.014 | artificial | AA | QVQLLESGGGLVQPGGSLRLSCAASGFTFSSYAMNWVRQAPGKGLEWVSTISGGANTYYAESVKGRFTISRDNSKSTLYLQMNSLRAEDTAVYHCAKGGYYYGMDVWGQGTLVTVSS |
| 1772 | VL of CDH19 65236.014 | artificial | NT | GAGATCGTGATGACCCAGTCCCCCGATCCCCTGTCCCTGAGCGTGACCCCTGGCGAGAGAGCCACCCTGTCTTGCCGGGCCTCCCAGTCCATTCCCAGCAACCTGGCTTCCGGCTGTTCCAGCAGAAGCCCGGCCAGGCCCCTCGGCTGCTGATCTACGGCGCCTTTACCCGGGCCACCGGCATCCCTGCCAGATTCTCTGGCTCCGGCTCCGGCACCGAGTTCACCCTGACCATCAGCTCCCTGGAGCCCGAGGACTTTGCCGTGTACTACTGCCAGCAGTACAACTACTGGCCCCTGACCTTCGGCGGAGGCACCAAGGTGGAAATCAAGTCC |
| 1773 | VL of CDH19 65236.014 | artificial | AA | EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS |
| 1774 | VH-VL of CDH19 65236.014 | artificial | NT | CAGGTGCAGCTGCTGGAATCCGGCGGAGGACTGGTCCAGCCTGGCGGCTCCCTGAGACTGTCTTGCGCCGCTTCCGGCTTCACCTTCTCCAGCTACGCCATGAACTGGGTCCGACAGGCCCCTGGCAAGGGCCTGGAATGGGTGTCCACCATCAGCGGCGAGGCGCAACACCTACTACGCCGAGTCCGTGAAGGGCCGGTTCACCATCTCCCGGGACAACTCCAAGTCCACCCTGTACCTGCAGATGAACTCCCTGAGAGCCGAGGACACCGCCGTGTACTACTGTGCTAAGGGCGGCTACTACTACGGCATGGATGTGTGGGGCCAGGGCACCCTCGTGACCGTGTCCTCAGGAGGCGGCGGATCTGGCGGCGGAGGCTCCGGAGGCGGAGGATCTGAGATCGTGATGACCCAGTCCCCCGATCCCCTGTCCCTGAGCGTGACCCCTGGCGAGAGAGCCACCCTGTCTTGCCGGGCCTCCCAGTCCATTCCCAGCAACCTGGCTTCCGGCTGTTCCAGCAGAAGCCCGGCCAGGCCCCTCGGCTGCTGATCTACGGCGCCTTTACCCGGGCCACCGGCATCCCTGCCAGATTCTCTGGCTCCGGCTCCGGCACCGAGTTCACCCTGACCATCAGCTCCCTGGAGCCCGAGGACTTTGCCGTGTACTACTGCCAGCAGTACAACTACTGGCCCCTGACCTTCGGCGGAGGCACCAAGGTGGAAATCAAGTCC |
| 1775 | VH-VL of CDH19 65236.014 | artificial | AA | QVQLLESGGGLVQPGGSLRLSCAASGFTFSSYAMNWVRQAPGKGLEWVSTISGGANTYYAESVKGRFTISRDNSKSTLYLQMNSLRAEDTAVYHCAKGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS |
| 1776 | CDH19 65236.014 x I2C | artificial | AA | QVQLLESGGGLVQPGGSLRLSCAASGFTFSSYAMNWVRQAPGKGLEWVSTISGGANTYYAESVKGRFTISRDNSKSTLYLQMNSLRAEDTAVYHCAKGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH |
| 1777 | CDR-H1 of CDH19 65237.001 | artificial | AA | RYGIH |

TABLE VI-continued

| SEQ ID NO. | DESIGNATION | SOURCE | TYPE | SEQUENCE |
|---|---|---|---|---|
| 1778 | CDR-H2 of CDH19 65237.001 | artificial | AA | VIWYDGSNKYYADSVKG |
| 1779 | CDR-H3 of CDH19 65237.001 | artificial | AA | RAGIPGTTGYYYGMDV |
| 1780 | CDR-L1 of CDH19 65237.001 | artificial | AA | SGDRLGEKYVS |
| 1781 | CDR-L2 of CDH19 65237.001 | artificial | AA | QDNKWPS |
| 1782 | CDR-L3 of CDH19 65237.001 | artificial | AA | QAWDSSTVV |
| 1783 | VH of CDH19 65237.001 | artificial | NT | CAGGTGCAGCTGGTGCAGTCCGGAGGCGGTGGTCCAGCCTGGGCGGTCCCTGAGACTGTCTTGCGCCGCCTCCGGCTTCACCTT CTCCAGATACGGCATCCACTGGGTCCGACAGGCCCCTGGCAAGGGCCTGGAATGGGTGGCCGTGATTTGGTACGACGGCTCCAACA AGTACTACGCCGACTCCGTGAAGGGCCGGTTCACCATCTCCCGGGACAACTCCAAGAACACCCTGTACCTGCAGATGAACTCCCTG CGGGCCGAGGACTCCGAGGACTACTGTGCCAGAAGGGCCGGCATCCCCGGCACCACCGGCTACTACTACGGCATGGATGTGTG GGGCCAGGGCACCACCGTGACCGTGTCTAGC |
| 1784 | VH of CDH19 65237.001 | artificial | AA | QVQLVESGGGVVQPGRSLRLSCAASGFTFSRYGIHWVRQAPGKGLEWVAVIWYDGSNKYYADSVKGRFTISRDNSKNTLYLQMNSL RAEDSAVYYCARRAGIPGTTGYYYGMDVWGQGTTVTVSS |
| 1785 | VL of CDH19 65237.001 | artificial | NT | TCTTACGAGCTGACCCAGCCCCCCTCCGTGTCTGTGTCTCCTGGCCAGACCGCCTCCATCACCTGTTCTGGCGACCGGCTGGGCGA GAAATACGTGAGCTGGTATCAGCAGAAGCCCGGACAGTCCCCCATCCTGGTCATCTACCAGGACAACAAGTGGCCCTCCGGCATCC CTGAGCGGTTCTCCGGCTCCAACTCCGGCAACACCGCCACCCTGACCATCTCCGGCACCCAGGCCATGGACGAGGCCGACTACTAC TGCCAGGCCTGGACTCCTCCACCGTGGTTCGGCGGAGGCACCAAGCTGACCGTGCTCC |
| 1786 | VL of CDH19 65237.001 | artificial | AA | SYELTQPPSVSVSPGQTASITCSGDRLGEKYVSWYQQKPGQSPILVIYQDNKWPSGIPERFSGSNSGNTATLTISGTQAMDEADYY CQAWDSSTVVFGGGTKLTVLS |
| 1787 | VH-VL of CDH19 65237.001 | artificial | NT | CAGGTGCAGCTGGTGCAGTCCGGAGGCGGTGGTCCAGCCTGGGCGGTCCCTGAGACTGTCTTGCGCCGCCTCCGGCTTCACCTT CTCCAGATACGGCATCCACTGGGTCCGACAGGCCCCTGGCAAGGGCCTGGAATGGGTGGCCGTGATTTGGTACGACGGCTCCAACA AGTACTACGCCGACTCCGTGAAGGGCCGGTTCACCATCTCCCGGGACAACTCCAAGAACACCCTGTACCTGCAGATGAACTCCCTG CGGGCCGAGGACACCGCCGTGTACTACTGTGCCAGAAGGGCCGGCATCCCCGGCACCACCGGCTACTACTACGGCATGGATGTGTG GGGCCAGGGCACCACCGTGACCGTGTCTAGCGGAGGCGGAGGATCTGGTGGCGGTGGTTCTGGCGGAGGCTCCTCTTACGAGC TGACCCAGCCCCCCTCCGTGTCTGTGTCTCCTGGCCAGACCGCCTCCATCACCTGTTCTGGCGACCGGCTGGGCGAGAAATACGTG AGCTGGTATCAGCAGAAGCCCGGACAGTCCCCCATCCTGGTCATCTACCAGGACAACAAGTGGCCCTCCGGCATCCCTGAGCGGTT CTCCGGCTCCAACTCCGGCAACACCGCCACCCTGACCATCTCCGGCACCCAGGCCATGGACGAGGCCGACTACTACTGCCAGGCCT GGGACTCCTCCACCGTGGTTCGGCGGAGGCACCAAGCTGACCGTGCTGTCC |
| 1788 | VH-VL of CDH19 65237.001 | artificial | AA | QVQLVESGGGVVQPGRSLRLSCAASGFTFSRYGIHWVRQAPGKGLEWVAVIWYDGSNKYYADSVKGRFTISRDNSKNTLYLQMNSL RAEDSAVYYCARRAGIPGTTGYYYGMDVWGQGTTVTVSSGGGGSGGGGSGGGGSYELTQPPSVSVSPGQTASITCSGDRLGEKYV SWYQQKPGQSPILVIYQDNKWPSGIPERFSGSNSGNTATLTISGTQAMDEADYYCQAWDSSTVVFGGGTKLTVLS |

TABLE VI-continued

| SEQ ID NO. | DESIGNATION | SOURCE | TYPE | SEQUENCE |
|---|---|---|---|---|
| 1789 | CDH19 65237.001 x I2C | artificial | AA | QVQLVESGGGVVQPGRSLRLSCAASGFTFSRYGIHWVRQAPGKGLEWVAVIWYDGSNKYYADSVKGRFTISRDNSKNTLYLQMNSL RAEDSAVYYCARRAGIPGTTGYYYGMDVWGQGTTVTVSSGGGGSGGGGSGGGGSYELTQPPSVSPGQTASITCSGDRLGEKYV SWYQQKPGQSGLKLSCAASGFTFNKYAMNWVRQAPGKGLEWVARIRSKYNNYATYYADSVKDRFTISRDDSKNTAYLQMNLKTED SGGGLVQPGGSLKLSCAASGFTFNKYAMNWVRQAPGKGLEWVARIRSKYNNYATYYADSVKDRFTISRDDSKNTAYLQMNLKTED TAVYYCVRHGNFGNSYISYWAYWGQGTLVTVSSGGGGSGGGGSGGGGSQTVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 1790 | CDR-H1 of CDH19 65237b.001 | artificial | AA | RYGIH |
| 1791 | CDR-H2 of CDH19 65237b.001 | artificial | AA | VIWYEGSNKYYAESVKG |
| 1792 | CDR-H3 of CDH19 65237b.001 | artificial | AA | RAGIPGTTGYYYGMDV |
| 1793 | CDR-L1 of CDH19 65237b.001 | artificial | AA | SGDRLGEKYVS |
| 1794 | CDR-L2 of CDH19 65237b.001 | artificial | AA | QDNKWPS |
| 1795 | CDR-L3 of CDH19 65237b.001 | artificial | AA | QAWESSTVV |
| 1796 | VH of CDH19 65237b.001 | artificial | NT | CAGGTGCAGCTGGTGGAATCCGGCGGCGAGGGCGTGGTGCAGCCTGGCCGGTCCCTGAGACTGTCTTGCGCCGCTTCCGGCTTCACCTT CTCCAGATACGGCCATCCACTGGGTCCGACAGGCCCCTGGCAAGGGCCTGGAATGGGTGGCCGTGATTTGGTACGAGGGCTCCAACA AGTACTACGCCGAGTCCGTGAAGGGCCGGTTCACCATCTCCCGGGACAACTCCAAGAACACCCTGTACCTGCAGATGAACTCCCTG CGGGCCGAGGACACCGCCGTGTACTACTGCGCCAGAAGGGCCGGCATCCCCGGCACCACCGGCTACTACTACGGCATGGATGTGTG GGGCCAAGGGCACCACCGTGACCGTGTCTAGC |
| 1797 | VH of CDH19 65237b.001 | artificial | AA | QVQLVESGGGVVQPGRSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSS |
| 1798 | VL of CDH19 65237b.001 | artificial | NT | TCTTACGAGCTGACCCAGCCCCCTAGCGTCCGGTCCCTGGCCCAGACCGCCTCCATCACCTGTTCTGGCGACAGGCTGGGCGAGAAGTACGTGAGCTGGTATCAGCAGAAGCCCGGCCAGTCCCCATCCTGGTCATCTACCAGGACAACAAGTGGCCCTCCGGCATCC CTGAGCGGGTTCTCCGGAAGTCCTCCGGCAACCGCCACCCTGACCATCTCGGCCAGGGCACCCAGGCACCAAGCTGACCGTGCTCC TGCCAGGCCTGGAGTCCTCCGGCAACCGCCACCCTGACCATCTCGGCCAGGGCACCCAGGCACCAAGCTGACCGTGCTGTCC |
| 1799 | VL of CDH19 65237b.001 | artificial | AA | SYELTQPPSVSPGQTASITCSGDRLGEKYVSWYQQKPGQSPILVIYQDNKWPSGIPERFSGSNSGNTATLTISTQAMDEADYY CQAWESSTVVFGGGTKLTVLS |
| 1800 | VH-VL of CDH19 65237b.001 | artificial | NT | CAGGTGCAGCTGGTGGAATCCGGCGGCGAGGGCGTGGTGCAGCCTGGCCGGTCCCTGAGACTGTCTTGCGCCGCTTCCGGCTTCACCTT CTCCAGATACGGCCATCCACTGGGTCCGACAGGCCCCTGGCAAGGGCCTGGAATGGGTGGCCGTGATTTGGTACGAGGGCTCCAACA AGTACTACGCCGAGTCCGTGAAGGGCCGGTTCACCATCTCCCGGGACAACTCCAAGAACACCCTGTACCTGCAGATGAACTCCCTG |

TABLE VI-continued

| SEQ ID NO. | DESIGNATION | SOURCE | TYPE | SEQUENCE |
|---|---|---|---|---|
| 1801 | VH-VL of CDH19 65237b.001 | artificial | AA | CGGGCCGAGGACTCCCGCGTGACTACTGTGCCAGAGAGGGCCGGACTCCCGGCACCACCGGCTACTACTACGGCATGGATGTGTG GGGCCAGGGCACCACCGTGACCGTGTCCTAGCGAGGCGGAGGATTCGGAGGCGGAGGCTCCGGCGGAGGCTCCTCTTACGAGC TGACCCAGCCCCCCCCCGTCCGTGTCCGTGTCCGTCCTGGCCAGACCGCCTCCATCACCTGTTCTGGCGACAAGTTGGGCCTCCGGCATCCTGAGCGGTT AGCTGGTATCAGCAGAAGCCCGGCCAGTCCCCCATCCTGGTCATCTACCAGGACAACAAGTGGCCCTCCGGCATCCCGAGCGGTT CTCCGGCTCCAACTCCGGCAACACCGCCACCCTGACCATCTCGGCTGGCAGGCCACCTGGAGCTGCAGCCTGACTACTACTGCCAGGCCT GGGAGTCCTCCACCGTGGTTCGGCGGAGGCACCAAGCTGACCGTGCTGTCC QVQLVESGGGVVQPGGSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSSGGGGSGGGGSSYELTQPPSVSVSPGQTASITCSGDRLGEKYV SWYQQKPGQSPILVIYQDNKWPSGIPERFSGSNSGNTATLTISGTQAMDEADYYCQAWESSTVVFGGGTKLTVLS |
| 1802 | CDH19 65237b.001 x I2C | artificial | AA | QVQLVESGGGVVQPGGSLRLSCAASGFTFSRYGIHWVRQAPGKGLEWVAVIWYEGSNKYYAESVKGRFTISRDNSKNTLYLQMNSL RAEDSAVYYCARRAGIPGTTGYYYGMDVWGQGTTVTVSSGGGGSGGGGSSYELTQPPSVSVSPGQTASITCSGDRLGEKYV SWYQQKPGQSPILVIYQDNKWPSGIPERFSGSNSGNTATLTISGTQAMDEADYYCQAWESSTVVFGGGTKLTVLSGGGGSEVQLVE SGGGLVQPGGSLRLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSQTVVTQEPSLTVSPGGTVTLTCGSSTGAVTSGNYPNWV QQKPGQAPRGLIGGTKFLAPGTPARFSGSLLGKAALTLSGVQPEDEAEYCVLWYSNRWVFGGGTKLTVLHHHHHH |
| 1803 | CDR-H1 of CDH19 65237.002 | artificial | AA | RYGIH |
| 1804 | CDR-H2 of CDH19 65237.002 | artificial | AA | VIWYDGSNKYYADSVKG |
| 1805 | CDR-H3 of CDH19 65237.002 | artificial | AA | RAGIPGTTGYYYGMDV |
| 1806 | CDR-L1 of CDH19 65237.002 | artificial | AA | SGDRLGEKYVS |
| 1807 | CDR-L2 of CDH19 65237.002 | artificial | AA | QDNKWPS |
| 1808 | CDR-L3 of CDH19 65237.002 | artificial | AA | QAWDSSTVV |
| 1809 | VH of CDH19 65237.002 | artificial | NT | CAGGTGCAGCTGGTGGAATCCGGCGGAGGCGTGGTGCAGCCTGGCGGCTCCCTGAGACTGTCTTGCGCCGCCTCCGGCTTCACCTT CTCCAGATACGGCATCCACTGGGTCCGACAGGCCCCTGGCAAGGGCCTGGAATGGGTGGCCGTGATTTGGTACGACGGCTCCAACA AGTACTACGCCGAGGACTCCGTGAAGGGCCGGTTCACCATCTCCCGGGACAACTCCAAGAACACCCTGTACCTGCAGATGAACTCCCTG CGGGCCGAGGACACCGCCGTGTACTACTGTGCCAGAAGGGCCGGCATCCCCGGCACCACCGGCTACTACTACGGCATGGATGTGTG GGGCCAGGGCACCACCGTGACCGTGTCTAGC |
| 1810 | VH of CDH19 65237.002 | artificial | AA | QVQLVESGGGVVQPGGSLRLSCAASGFTFSRYGIHWVRQAPGKGLEWVAVIWYDGSNKYYADSVKGRFTISRDNSKNTLYLQMNSL RAEDSAVYYCARRAGIPGTTGYYYGMDVWGQGTTVTVSS |

TABLE VI-continued

| SEQ ID NO. | DESIGNATION | SOURCE | TYPE | SEQUENCE |
|---|---|---|---|---|
| 1811 | VL of CDH19 65237.002 | artificial | NT | TCTTACGAGCTGACCCAGCCCCCCTCCGTGTCCGTGTCTCCTGGCCAGACCGCCTCCATCACCTGTTCTGGCGACCGGCTGGGCGA<br>GAAATACGTGAGCTGGTATCAGCAGAAGCCCGGCCAGTCCCCCATCCTGGTCATCTACCAGGACAACAAGTGGCCCTCCGGCATCC<br>CTGAGCGGTTCTCCGGCTCCAACTCCGGCAACACCGCCACCCTGACCATCTCCGGCACCCAGGCCATGGACGAGGCCGACTACTAC<br>TGCCAGGCCTGGGACTCCACCGTGTTCGGCGGAGGCACCAAGCTGACCGTGCTGTCC |
| 1812 | VL of CDH19 65237.002 | artificial | AA | SYELTQPPSVSVSPGQTASITCSGDRLGEKYVSWYQQKPGQSPILVIYQDNKWPSGIPERFSGSNSGNTATLTISGTQAMDEADYY<br>CQAWDSTVFGGGTKLTVLS |
| 1813 | VH-VL of CDH19 65237.002 | artificial | NT | CAGGTGCAGCTGGTGGAATCCGGCGGAGGCGTGGTGCAGCCTGGCGGCTCTCTGAGACTGTCTTGCGCCGCCTCCGGCTTCACCTT<br>CTCCAGATACGGCATCCACTGGGTCCGACAGGCCCCTGGCAAGGGCCTGGAATGGGTGGCCGTGATTTGGTACGACGGCTCCAACA<br>AGTACTACGCCGACTCCGTGAAGGGCCGGTTCACCATCTCCGTCGCCGGACAACTCCAAGAACACCCTGTACCTGCAGATGAACTCCCTG<br>CGGGCCGAGGACTCCGCCGTGTACTACTGTGCCAGAGAGGCCGGAGATCTGGTGGCTTGTCGGCGGAGGCTCCTTACGAGC<br>GGGCCAGGGACCACCGTGACCGTGTCTAGCGGAGGCGGAGGATCTGGTGGCGGCGCGGCGGCTGTCTAGCGGAGGCTCCTTACGAGC<br>TGACCCAGCCCCCCTCCGTGTCCGTGTCTCCTGGCCAGACCGCCAGTCCCATCCTGTTCATCTACCAGGACAACAAGTGGCCCTCCGGCATCCC<br>AGTCGGTTCTCCGGCTCCAACTCCGGCAACACCGCCACCCTGACCATCTCCGGCACCCAGGCCATGGACGAGGCCGACTACTACTGCCAGGCC<br>TGGGACTCCACCGTGTTCGGCGGAGGCACCAAGCTGACCGTGCTGTCC |
| 1814 | VH-VL of CDH19 65237.002 | artificial | AA | QVQLVESGGGVVQPGGSLRLSCAASGFTFSRYGIHWVRQAPGKGLEWVAVIWYDGSNKYYADSVKGRFTISRDNSKNTLYLQMNSL<br>RAEDSAVYYCAREDSAVYYCARRAGIPGTTGYYYGMDVWGQGTTVTVSSGGGGSGGGGSSYELTQPPSVSVSPGQTASITCSGDRLGEKYV<br>SWYQQKPGQSPILVIYQDNKWPSGIPERFSGSNSGNTATLTISGTQAMDEADYYCQAWDSTVFGGGTKLTVLS |
| 1815 | CDH19 65237.002 × I2C | artificial | AA | QVQLVESGGGVVQPGGSLRLSCAASGFTFSRYGIHWVRQAPGKGLEWVAVIWYDGSNKYYADSVKGRFTISRDNSKNTLYLQMNSL<br>RAEDSAVYYCARRAGIPGTTGYYYGMDVWGQGTTVTVSSGGGGSGGGGSSYELTQPPSVSVSPGQTASITCSGDRLGEKYV<br>SWYQQKPGQSPILVIYQDNKWPSGIPERFSGSNSGNTATLTISGTQAMDEADYYCQAWDSTVFGGGTKLTVLSGGGGSEVQLVE<br>SGGGLVQPGGSLKLSCAASGFTFNKYAMNWVRQAPGKGLEWVARIRSKYNNYATYYADSVKDRFTISRDDSKNTAYLQMNNLKTED<br>TAVYYCVRHGNFGNSYISYWAYWGQGTLVTVSSGGGGSGGGGSGGGGSQTVVTQEPSLTVSPGGTVTLTCGSSTGAVTSGNYPNWV<br>QQKPGQAPRGLIGGTKFLAPGTPARFSGSLLGGKAALTLSGVQPEDEAEYYCVLWYSNRWVFGGGTKLTVLHHHHHH |
| 1816 | CDR-H1 of CDH19 65238.002 | artificial | AA | SSGYYWS |
| 1817 | CDR-H2 of CDH19 65238.002 | artificial | AA | YIYYTGSAYYNPSLKS |
| 1818 | CDR-H3 of CDH19 65238.002 | artificial | AA | DGSSGWYFQY |
| 1819 | CDR-L1 of CDH19 65238.002 | artificial | AA | RASRQISSSYLA |
| 1820 | CDR-L2 of CDH19 65238.002 | artificial | AA | GPSSRAT |

TABLE VI-continued

| SEQ ID NO. | DESIGNATION | SOURCE | TYPE | SEQUENCE |
|---|---|---|---|---|
| 1821 | CDR-L3 of CDH19 65238.002 | artificial | AA | QQYGSSFT |
| 1822 | VH of CDH19 65238.002 | artificial | NT | CAGGTGCAGCTGCAGGAATCCGGCCCTGGCCCTGGTCAAGCCCTCTGACCTGTCCTGAGACCCTGTCCTGCACCGTGCCGGCTCCAT CTCCTCCTCCGGCTACTACTGGTCTGGATCCGGATCCAGAGCCGGATCCGGATCGGCTACTACTACTGAGCCGGCT GCGCTACTACAACCCAGCTGAAGTCCAGAGTGACCATCTCGTGGACACCTCAGAGTTCTCCCTGAAGCTGTCCTC GTGACCGCCGTGACACCTGTCTACTACTGCGCCAGAGATGGCTCCAGCGGCTGTACTTCCAGTACTGGGCCAGGGCACCCT GGTCACCGTGTCTAGC |
| 1823 | VH of CDH19 65238.002 | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSS |
| 1824 | VL of CDH19 65238.002 | artificial | NT | GAGATCGTGCTGACCCAGTCCCCCGGCACCCTGTCTCTGAGCCCTGGCGAGAGAGCCACCCTGTCCTGCCGGGCCTCCCAGAGAT CTCCTCCAGTACCTGGCTTGGTATCAGCAGAAGCCCGGCCAGGCCCCTAGACTGCTGATCTACGGCGCCTAGCCGGGCACCACCG GCATCCCTGACAGGGCTTCTGGCTCTGGCAGCTCCCGGCGCCATCTTCAGCGCCTGGAACCCGACGACTTCGCCGTG TACTACTGCCAGCAGTACGGCTCCTCCTTCACCTTCGGCCAGGGCACCAAGGTGGACATCAAGTCC |
| 1825 | VL of CDH19 65238.002 | artificial | AA | EIVLTQSPGTLSLSPGERATLSCRASRQISSSYLAWYQQKPGQAPRLLIYGASSRATGIPDRFSGSGSGTDFTLTISRLEPEDFAV YYCQQYGSSFTFGQGTKVDIKS |
| 1826 | VH-VL of CDH19 65238.002 | artificial | NT | CAGGTGCAGCTGCAGGAATCCGGCCCTGGCCCTGGTCAAGCCCTCTGACCTGTCCTGAGACCCTGTCCTGCACCGTGCCGGCTCCAT CTCCTCCTCCGGCTACTACTGGTCTGGATCCGGATCCAGAGCCGGATCCGGATCGGCTACTACTACTGAGCCGGCT CCGCTACTACAACCCAGCTGAAGTCCAGAGTGACCATCTCGTGGACACCTCAGAGTTCTCCCTGAAGCTGTCCTC GTGACCGCCGTGACACCTGTCTACTACTGCGCCAGAGATGGCTCCAGCGGCTGTACTTCCAGTACTGGGCCAGGGCACCCT GGTCACCGTGTCTAGCGGCGGAGGAGGATCGTGTGGCGGCGCCCCTCTGCGGCGCTCCCAGATCTCCTCCAGCTACCTGGCTTGGTAT CAGCAGAAGCCCGGCCAGGCCCCTAGACTGCTGATCTACGGCGCCTCCTCCAGAGCCACCGGCATCCCTGACCGGTTCTCCGGCTC TGGCTCCGGCACCGACTTCACCCTGACCATCAGCCGTCTGGAACCCGAGGACTTCGCCGTACTACTGCCAGCAGTACGGCTCCTCT CCTTCACCTTCGGCCAGGGCACCAAGGTGGACATCAAGTCC |
| 1827 | VH-VL of CDH19 65238.002 | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSSGGGGSGGGGSGGGGSETVLTQSPGTLSLSPGERATLSCRASRQISSSYLAWY QQKPGQAPRLLIYGASSRATGIPDRFSGSGSGTDFTLTISRLEPEDFAVYYCQQYGSSFTFGQGTKVDIKS |
| 1828 | CDH19 65238.002 x 12C | artificial | AA | QVQLQESGPGLVKPSETLSLTCTVSGGSISSSGYYWSWIRQPPGKGLEWIGYIYYTGSAYYNPSLKSRVTISVDTSKNQFSLKLSS VTAADTAVYYCARDGSSGWYFQYWGQGTLVTVSSGGGGSGGGGSGGGGSEIVLTQSPGTLSLPGERATLSCRASRQISSSYLAWY QQKPGQAPRLLIYGPSSRATGIPDRFSGSGSGTDFTLTISRLEPEDFAVYYCQQYGSSFTFGQGTKVDIKSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQGTLVTVSSGGGGSGGGGSGGGSQTVVTGEPSLTVSPGGTVTLTCGSSTGAVTSGNYPNWVQQKP GQAPRGLIGGTIKFLAPGTPARFSGSILLGGKAALTLSGVQPEDEAEYYCVLMYSNRWVFGGGTKLTVLHHHHHH |
| 1829 | CDR-H1 of CDH19 65238.004 | artificial | AA | SSGYYWS |
| 1830 | CDR-H2 of CDH19 65238.004 | artificial | AA | YIYYTGSAYYNPSLKS |

TABLE VI-continued

| SEQ ID NO. | DESIGNATION | SOURCE | TYPE | SEQUENCE |
|---|---|---|---|---|
| 1831 | CDR-H3 of CDH19 65238.004 | artificial | AA | DGSSGWYFQY |
| 1832 | CDR-L1 of CDH19 65238.004 | artificial | AA | RASRQISSSYLA |
| 1833 | CDR-L2 of CDH19 65238.004 | artificial | AA | GPSSRAT |
| 1834 | CDR-L3 of CDH19 65238.004 | artificial | AA | QQYGSSFT |
| 1835 | VH of CDH19 65238.004 | artificial | NT | CAGGTCAGCTGCAGGAATCCGGCCCTGGCCTGGTCAAGCCCTCTGCCTGACCCTGTCCTGCACCGTCTCCAT CTCCTCCTACTACAACCCAGCTGACTCTGGATCCGGCAGCCCCCCGGGCCAAGGGCCTGGAATGGATCGGCTACTACTACCGGCT CCGCTACTACAGAACCCGTGACACCGGCTGAGCTCCAGAGTGACACCTCCAGCTCTGACACCGGACGCCGCGTCTCCTC GTGACCGCCGTCTAGCGTCGTGACACCTGAGACTACTGCGCCGCAGAGATGGCTCCAGCGCACCTGGTACTTCCAGTACTACTGGGGCCAGGGCACCCT GGTCACCGTGTCTAGC |
| 1836 | VH of CDH19 65238.004 | artificial | AA | QVQLQESGPGLVKPSETLSLTCTVSGGSISSSGYYWSWIRQPPGKGLEWIGYIYYTGSAYNPSLKSRVTISVDTSKNQFSLKLSS VTAADTAVYYCARDGSSGWYFQYWGQGTLVTVSS |
| 1837 | VL of CDH19 65238.004 | artificial | NT | GAGATCGTGCTGACCCAGTCTCCTGGCTGAACCGGAGAGCCACCCTGTCCTGCCGGGCCTCCCGCAGAT CTCTCCAGCTACTGTGGCTTGGTATCAGCAGAAGCCCGGACAGGCCCCTAGCCTGCTGATCTACGGCCCTAGCTCACGGCGACCACCG GCATCCCTGACCGGTTCTCCGGCTCTGGCTCCGGGCACCGACTTCACCCTGACCATCAGCCGCCTGGAACCCGAGGACTTCGCCGTG TACTATTGCCAGCAGTACGGCTCCTCCTTCACCTTCGGCCCTGGGACCAAGGTGGACATCAAGTCC |
| 1838 | VL of CDH19 65238.004 | artificial | AA | EIVLTQSPGTLSLSPGERATLSCRASRQISSSYLAWYQQKPGQAPRLLIYGPSSRATGIPDRFSGSGSGTDFTLTISRLEPEDFAV YYCQQYGSSFTFGPGTKVDIKS |
| 1839 | VH-VL of CDH19 65238.004 | artificial | NT | CAGGTCAGCTGCAGGAATCCGGCCCTGGTCAAGCCCTCTGAGACCCTGTCCTGCACCGTGTCCGGCGGCTCCAT CTCCTCCTACTACAACCCAGCTGACTCTGGATCCGGCAGCCCCCCGGGCCAAGGGCCTGGAATGGATCGGCTACTACTACCGGCT CCGCTACTACAGAACCCGTGACACCAGCCAGCCACCTCCAGCGCTGCGCTCCCTTCCAGCAGCTGACACCGGACGCTGGGGCCAGGGCACCCT GGTCACCGTGTCTAGCGGCGGAGGCGGAGAGCTGGTGGCGGTGGTTCTGGCGGAGGCGGCAGCGAGATCGTGCTGACCCAGTCCCCG GCACCCTGTCTCTGAGCCCTGGAGCCCGGCCCGGAGCCACCCTGTCCTGCAGAGCCTAGCTCCGCGCAGCTCTCCTCACGCCGCATCCCCGCCCTGCCCTCCGACACCCT CAGCAGAAGCCCGGCCAGGCCCCTAGCTGCTGATCTACGGCCCATCCCTGACTATTGCCAGCAGTACGGTTCTCCGGCTC TGGCTCCGGCACCGACTTCACCCTGACCATCAGCCGCCTGGAACCCGAGGACTTCGCCGTGTACTATTGCCAGCAGTACGGCTCCT CCTTCACCTTCGGCCCTGGCACCAAGGTGGACATCAAGTCC |
| 1840 | VH-VL of CDH19 65238.004 | artificial | AA | QVQLQESGPGLVKPSETLSLTCTVSGGSISSSGYYWSWIRQPPGKGLEWIGYIYYTGSAYNPSLKSRVTISVDTSKNQFSLKLSS VTAADTAVYYCARDGSSGWYFQYWGQGTLVTVSSGGGGSGGGGSGGGGSEIVLTQSPGTLSLSPGERATLSCRASRQISSSYLAWY QQKPGQAPRLLIYGPSSRATGIPDRFSGSGSGTDFTLTISRLEPEDFAVYYCQQYGSSFTFGPGTKVDIKS |
| 1841 | CDH19 65238.004 x I2C | artificial | AA | QVQLQESGPGLVKPSETLSLTCTVSGGSISSSGYYWSWIRQPPGKGLEWIGYIYYTGSAYNPSLKSRVTISVDTSKNQFSLKLSS VTAADTAVYYCARDGSSGWYFQYWGQGTLVTVSSGGGGSGGGGSGGGGSEIVLTQSPGTLSLSPGERATLSCRASRQISSSYLAWY QQKPGQAPRLLIYGPSSRATGIPDRFSGSGSGTDFTLTISRLEPEDFAVYYCQQYGSSFTFGPGTKVDIKSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY |

TABLE VI-continued

| SEQ ID NO. | DESIGNATION | SOURCE | TYPE | SEQUENCE |
|---|---|---|---|---|
| | | | | YCVRHGNFGNSYISTWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARFSGSLLGGKAALTLSGVQPEDEAEYYCVLWYSNRWVFGGGTKLTVLHHHHHH |
| 1842 | CDR-H1 of CDH19 65240.002 | artificial | AA | SYDMH |
| 1843 | CDR-H2 of CDH19 65240.002 | artificial | AA | VISYDGTNEYYADSVKG |
| 1844 | CDR-H3 of CDH19 65240.002 | artificial | AA | ERYFDWSFDY |
| 1845 | CDR-L1 of CDH19 65240.002 | artificial | AA | RASQSVSNTYLA |
| 1846 | CDR-L2 of CDH19 65240.002 | artificial | AA | GASSRAT |
| 1847 | CDR-L3 of CDH19 65240.002 | artificial | AA | QQYSNSWT |
| 1848 | VH of CDH19 65240.002 | artificial | NT | CAGGTGCAGCTGGTGGAATCCGGCGGAGGCGTGGTGCAGCCTGGCGGGTCCCTGCGCCTCTCGGCTGTCTTGCGCCCTCCGGCTTCACCTT CTCCAGCTACGACATGCACTGGGTCCGACAGGCCCCTGGAAAGGGTCTGGAATGGGTGGCCGTGATCTCCTACGACGGCACCAACG AGTACTACGCCGACTCCGTGAAGGGCCGGTTCACCATCTCCCGGGACAACTCCAAGAACACCCTGTACCTGCAGATGAACTCCCTG CGGGCCGAGGACACCGCCGTGTACTACTGCGCCAGAGAGCGTACTTCGACTGGTCCTTCGACTACTGGGGCCAGGGCACCCTGGT GTCCGTGTCTAGC |
| 1849 | VH of CDH19 65240.002 | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSS |
| 1850 | VL of CDH19 65240.002 | artificial | NT | GAGATCGTGCTGACCCAGTCCCCTGGCACCCTGTCCCTGAGCCCCGGCGAGAGAGCCACCCTGTCTTGCCGGGCCTCCCAGTCCGT GTCCAACACCTACCTGGCCTGGTATCAGCAGCGCCCTGGCCAGGCCCCTCGGCTGCTGATCTACGGCGCCTCTTCCAGAGCCACCG GCATCCCTGACCGGTTCTCCGGCTCTGGCTCTGGAACCGACTTCACCCTGACCATCTCCAGCCTGGAACCCGAGGATTTCGCTGTG TACTATTGCCAGCAGTACTCCAACTCCTGGACTTTCGGACAGGGCACCAAGGTGGAAATCAAGTCC |
| 1851 | VL of CDH19 65240.002 | artificial | AA | EIVLTQSPGTLSLSPGERATLSCRASQSVSNTYLAWYQQRPGQAPRLLIYGASSRATGIPDRFSGSGSGTDFTLTISSLEPEDFAV YYCQQYSNSWTFGQGTKVEIKS |
| 1852 | VH-VL of CDH19 65240.002 | artificial | NT | CAGGTGCAGCTGGTGGAATCCGGCGGAGGCGTGGTGCAGCCTGGCGGGTCCCTGCGCCTCTCGGCTGTCTTGCGCCCTCCGGCTTCACCTT CTCCAGCTACGACATGCACTGGGTCCGACAGGCCCCTGGAAAGGGTCTGGAATGGGTGGCCGTGATCTCCTACGACGGCACCAACG AGTACTACGCCGACTCCGTGAAGGGCCGGTTCACCATCTCCCGGGACAACTCCAAGAACACCCTGTACCTGCAGATGAACTCCCTG CGGGCCGAGGACACCGCCGTGTACTACTGCGCCAGAGAGCGGTACTTCGACTGGTCCTTCGACTACTGGGGCCAGGGCACCCTGGT GTCCGTGTCTAGCGGAGGCGGAGGATCTGGTGGCGGTGGTTCTGGCGGCGGAGGCTCCGAGATCGTGCTGACCCAGTCCCCTGGCA CCCTGTCCCTGAGCCCTGGCGAGAGAGCCACCCTGTCTTGCCGGGCCTCCCAGTCCGTGTCCAACACCTACCTGGCCTGGTATCAG CAGCGCCCTGGCCAGGCCCCTCGGCTGCTGATCTACGGCGCCATCCTGATCTACGCCTCTTCCAGAGCCACCGGCATCCCTGACCGGTTCTCCGGCTCTGG |

| SEQ ID NO. | DESIGNATION | SOURCE | TYPE | SEQUENCE |
|---|---|---|---|---|
| | | | | CTCTGGCACCGACTTCACCCTGACCATCTCCAGCCTGGAACCCGAGGATTCGCTGTGTACTATTGCCAGCAGTACTCCAACTCCT |
| 1853 | VH-VL of CDH19 65240.002 | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QRPGQAPRLLIYGASSRATGIPDRFSGSGSGTDFTLTISSLEPEDFAVYYCQQYSNSWTFGQGTKVEIKS |
| 1854 | CDH19 65240.002 x I2C | artificial | AA | QVQLVESGGGVVQPGGSLRLSCAASGFTFSSYDMHWVRQAPGKGLEWVAVISYDGTNEYYADSVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QRPGQAPRLLIYGASSRATGIPDRFSGSGSGTDFTLTISSLEPEDFAVYYCQQYSNSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKALTLSGVPEDEAEYYCVLWYSNRWVFGGGTKLTVLHHHHHH |
| 1855 | CDR-H1 of CDH19 65240.003 | artificial | AA | SYDMH |
| 1856 | CDR-H2 of CDH19 65240.003 | artificial | AA | VISYEGTNEYYAESVKG |
| 1857 | CDR-H3 of CDH19 65240.003 | artificial | AA | ERYFDWSFDY |
| 1858 | CDR-L1 of CDH19 65240.003 | artificial | AA | RASQSVSNTYLA |
| 1859 | CDR-L2 of CDH19 65240.003 | artificial | AA | GASSRAT |
| 1860 | CDR-L3 of CDH19 65240.003 | artificial | AA | QQYSNSWT |
| 1861 | VH of CDH19 65240.003 | artificial | NT | CAGGTGCAGCTCGTGGAATCCGGCGGTGTGCAGCCTGGCCTGGCCGGCTCCCTGAGACTGTCTTGCGCCGCCTCCGGCTTCACCTT CTCCAGCTACGACATGCACTGGGTCCGACAGGCCCCTGGCAAGGGCCTGGAATGGGTGGCCGTGATCTCCTACGAGGGCACCAACG AGTACTACGCCGAGTCCGTGAAGGGCCGGTTCACCATCTCCCGGGACACCTCCAAGAACACCCTGTACCTGCAGATGAACTCCCTG CGGGCCGAGGACACCGCCGTGTACTACTGCGCCAGAGAGCGGTACTTCGACTGGTCCTTCGACTACTGGGGCCAGGGCACCCTGGT GTCCGTGTCTAGC |
| 1862 | VH of CDH19 65240.003 | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSS |
| 1863 | VL of CDH19 65240.003 | artificial | NT | GAGATCGTGCTGACCCAGTCCCCTGCCACCCTGTCCCTGAGCCCTGGCGAGAGAGCCACCCTGTCTTGCCGGGCTCCCAGTCCGT GTCCAACACCTACCTGGCCTGGTATCAGCAGCGCCCTGGCCAGGCCCCTCGGCTGCTGATCTACGGCGCCTCTTCCAGAGCCACCG GCATCCCTGACCGGTTCTCCGGCTCTGGCTCCGGCACCGACTTCACCCTGACCATCTCCAGCCTGGAACCCGAGGATTTCGCTGTG TACTATTGCCAGCAGTACTCCAACTCCTGGACCTTCGGACAGGGCACCAAGGTGGAAATCAAGTCC |

TABLE VI-continued

| SEQ ID NO. | DESIGNATION | SOURCE | TYPE | SEQUENCE |
|---|---|---|---|---|
| 1864 | VL of CDH19 65240.003 | artificial | AA | EIVLTQSPGTLSLSPGERATLSCRASQSVSNTYLAWYQQRPGQAPRLLIYGASSRATGIPDRFSGSGSGTDFTLTISSLEPEDFAV YYCQQYSNSWTFGQGTKVEIKS |
| 1865 | VH-VL of CDH19 65240.003 | artificial | NT | CAGGTGCAGCTGGTGGAATCCGGCGGAGGCGTGGTGCAGCCTGGCGGTTCCCTGCGCCTGTCTTGCGCCGCTTCACCTT CTCCAGCTACGACATGCACTGGGTCCGACAGGCCCCTGGCAAGGGCCTGGAATGGGTGGCCGTGATCTCTTACGAGGGCACCAACG AGTACTACGCCGAGTCCGTGAAGGGCCGGTTCACCATCTCCCGGGACAACTCCAAGAACACCCTGTACCTGCAGATGAACTCCCTG CGGGCCGAGGACACCGCCGTGTACTACTGCGCCAGAGAGCGGTACTTTGACTGGTCTTTCGACTACTGGGGCCAGGGCACCCTGGT GTCCGTGTCTAGCGGAGGCGGAGGATCGGTGGCGGCGGAGGATCTGGCGGAGGCGGCAGCGAGATCGTGCTGACCCAGTCCCCTGGCA CCCTGTCCCTGAGCCCTGGCGAGCGGGCCACCCTGTCTTGCCGGGCCAGCCAGTCCGTTCTCAACACCTACCTGGCCTGGTATCAG CAGCGCCCTGGCCAGGCCCCTCGGCTGCTGATCTACGGCGCCTCTTCCAGAGCCACCGGCATCCCTGACCGGTTCTCCGGCTCTGG CTCTGGCACCGACTTCACCCTGACCATCTCCAGCCTGGAACCCGAGGATTTCGCTGTGTACTATTGCCAGCAGTACTCCAACTCCT GGACCTTCGGACAGGGCACCAAGGTGGAAATCAAGTCC |
| 1866 | VH-VL of CDH19 65240.003 | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QRPGQAPRLLIYGASSRATGIPDRFSGSGSGTDFTLTISSLEPEDFAVYYCQQYSNSWTFGQGTKVEIKS |
| 1867 | CDH19 65240.003 x I2C | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QRPGQAPRLLIYGASSRATGIPDRFSGSGSGTDFTLTISSLEPEDFAVYYCQQYSNSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 1868 | CDR-H1 of CDH19 65240.004 | artificial | AA | SYDMH |
| 1869 | CDR-H2 of CDH19 65240.004 | artificial | AA | VISYEGTNEYYAESVKG |
| 1870 | CDR-H3 of CDH19 65240.004 | artificial | AA | ERYFDWSFDY |
| 1871 | CDR-L1 of CDH19 65240.004 | artificial | AA | RASQSVSNTYLA |
| 1872 | CDR-L2 of CDH19 65240.004 | artificial | AA | GASSRAT |
| 1873 | CDR-L3 of CDH19 65240.004 | artificial | AA | QQYSNSWT |
| 1874 | VH of CDH19 65240.004 | artificial | NT | CAGGTGCAGCTGGTGGAATCCGGCGGAGGCGTGGTGCAGCCTGGCGGTTCCCTGCGCCTGTCTTGCGCCGCTTCACCTT CTCCAGCTACGACATGCACTGGGTCCGACAGGCCCCTGGCAAGGGCCTGGAATGGGTGGCCGTGATCTCCTACGAGGGCACCAACG |

TABLE VI-continued

| SEQ ID NO. | DESIGNATION | SOURCE | TYPE | SEQUENCE |
|---|---|---|---|---|
| 1875 | VH of CDH19 65240.004 | artificial | AA | AGTACTACGCCCAGTCCGTGAAGGGCCGGTTCACCATCTCCCGGGACACCTCCAAGAACACCCTGTACCTGCAGATGAACTCCCTG CGGGCCGAGGACACCGCCGTGTACTACTGCCAGAGAGCGTACTTCGACTGGTCCTTCGACTACTGGGGCCAGGGCACCCTGGT GTCCGTGTCTAGC QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSS |
| 1876 | VL of CDH19 65240.004 | artificial | NT | GAGATCGTGCTGACCCAGTCCCCTGGCACCCTGTCCCTGTCTCCTGGCGAGAGAGCCACCCTGTCTTGTCGGGCCTCCCAGTCCGT GTCCAACACCTACCTGGCTGGTATCAGCAGAAGCCTGGCCAGGCCCCTCGGCTGCTGATCTACGGCGCCTCTTCCAGAGCCACCG GCATCCCTGACCGGTTCTCCGGCTCTGGCTCTGGCACCGACTTCACCCTGACCATCTCCAGCCTGGAACCTGAGGATTTCGCTGTG TACTATTGCCAGCAGTACTCCAACTCTGGAACCTTCGGACCAGGGCACCAAGGTGGAAATCAAGTCC |
| 1877 | VL of CDH19 65240.004 | artificial | AA | EIVLTQSPGTLSLSPGERATLSCRASQSVSNTYLAWYQQKPGQAPRLLIYGASSRATGIPDRFSGSGSGTDFTLTISSLEPEDFAV YYCQQYSNSWTFGQGTKVEIKS |
| 1878 | VH-VL of CDH19 65240.004 | artificial | NT | CAGGTGCAGCTGGTGGAATCCGGAGGCGGAGGCGTGCAGCCTGGAGGCTCCCTGAGACTGTCTTGCGCCGCCTCCGGCTTCACCTT CTCCAGCTACGACATGCACTGGGTCCGACAGGCCCCTGGCAAGGGCCTGGAATGGGTGGCCGTGATCTCCTACGAGGGCACCAACG AGTACTACGCCCAGTCCGTGAAGGGCCGGTTCACCATCTCCCGGGACACCTCCAAGAACACCCTGTACCTGCAGATGAACTCCCTG CGGGCCGAGGACACCGCCGTGTACTACTGCGCCAGAGAGCGTACTTCGACTGGTCCTTCGACTACTGGGGCCAGGGCACCCTGGT GTCCGTGTCTAGCGGCGGAGGCGGATCTGGTGGCGGTGGTTCTGGCGGCGGAGGCTCCGAGATCGTGCTGACCCAGTCCCCTGGCA CCCTGTCCCTGAGCCCTGGCGAGAGAGCCACCCTGTCTTGCCGGGCCTCCCAGTCCGTGTCCAACACCTACCTGGCCTGGTATCAG CAGAAGCCTGGCCAGGCCCCTCACCCTGACCATCTCAGCCTGGAGATCTACGGCGCCATCCCTGACCGGTTCTCCGGCTCTGGC CTCTGGCACCGACTTCACCCTGACCATCTCCAGCCTGGAACCCGAGGATTTCGCTGTGTACTATTGCCAGCAGTACTCCAACTCCT GGACCTTCGGACAGGGCACCAAGGTGGAAATCAAGTCC |
| 1879 | VH-VL of CDH19 65240.004 | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QKPGQAPRLLIYGASSRATGIPDRFSGSGSGTDFTLTISSLEPEDFAVYYCQQYSNSWTFGQGTKVEIKS |
| 1880 | CDH19 65240.004 x I2C | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVSVSSGGGGSGGGGSGGGGSEIVLTQSPGTLSLSPGERATLSCRASQSVSNTYLAWYQ QKPGQAPRLLIYGASSRATGIPDRFSGSGSGTDFTLTISSLEPEDFAVYYCQQYSNSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 1881 | CDR-H1 of CDH19 65240.005 | artificial | AA | SYDMH |
| 1882 | CDR-H2 of CDH19 65240.005 | artificial | AA | VISYEGTNEYYAESVKG |
| 1883 | CDR-H3 of CDH19 65240.005 | artificial | AA | ERYFDWSFDY |
| 1884 | CDR-L1 of CDH19 65240.005 | artificial | AA | RASQSVSNTYLA |

TABLE VI-continued

| SEQ ID NO. | DESIGNATION | SOURCE | TYPE | SEQUENCE |
|---|---|---|---|---|
| 1885 | CDR-L2 of CDH19 65240.005 | artificial | AA | GASSRAT |
| 1886 | CDR-L3 of CDH19 65240.005 | artificial | AA | QQYSNSWT |
| 1887 | VH of CDH19 65240.005 | artificial | NT | CAGGTGCAGCTGGTGGAATCTGGCGGAGGCGTGGTCCAGCCTGGGGTCCCTGAGACTGTCTTGCGCCGCTTCGGGCTTCACCTT CTCCAGCTACGACATGCACTGGGTCCGACAGGCCCCTGGCAAGGGCCTGGAATGGGTGGCCGTGATCTCTTACGAGGGCACCAACG AGTACTACGCCGAGTCCGTGAAGGGCCGGTTCACCATCTCCCGGACACCTCCAAGAACACCCTGTACCTGCAGATGAACTCCCTG CGGGCCGAGGACACCGCCGTGTACTACTGCGCCAGAGAGCGGTACTTCGACTGGTCCTTCGACTACTGGGGCCAGGGACCCTGGT GACCGTGTCTAGC |
| 1888 | VH of CDH19 65240.005 | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVTVSS |
| 1889 | VL of CDH19 65240.005 | artificial | NT | GAGATCGTGCTGACCCAGTCCCCTGGCACCCTGTCCCTGAGCCCTGGCGAGAGAGCCACCCTGTCTTGCCGGGCCTCCCAGTCCGT GTCCAACACCTACCTGGCCTGGTATCAGCAGAAGCCTGGCCAGGCCCCTCGGCTCCTGATCTACGGCGCCTCTTCCAGAGCCACCG GCATCCCTGACCGGTTCTCCGGCTCTGGCTCTGGCACCGACTTCACCCTGACCATCTCCAGCCTGGAACCCGAGGATTTCGCTGTG TACTATTGCCAGCAGTACTCCAACTCCTGGACCTTCGGACAGGGCACCAAGGTGGAAATCAAGTCC |
| 1890 | VL of CDH19 65240.005 | artificial | AA | EIVLTQSPGTLSLSPGERATLSCRASQSVSNTYLAWYQQKPGQAPRLLIYGASSRATGIPDRFSGSGSGTDFTLTISSLEPEDFAV YYCQQYSNSWTFGQGTKVEIKS |
| 1891 | VH-VL of CDH19 65240.005 | artificial | NT | CAGGTGCAGCTGGTGGAATCTGGCGGAGGCGTGGTCCAGCCTGGGGTCCCTGAGACTGTCTTGCGCCGCTTCGGGCTTCACCTT CTCCAGCTACGACATGCACTGGGTCCGACAGGCCCCTGGCAAGGGCCTGGAATGGGTGGCCGTGATCTCTTACGAGGGCACCAACG AGTACTACGCCGAGTCCGTGAAGGGCCGGTTCACCATCTCCCGGGACACCTCCAAGAACACCCTGTACCTGCAGATGAACTCCCTG CGGGCCGAGGACACCGCCGTGTACTACTGCGCCAGAGAGCGGTACTTCGACTGGTCCTTCGACTACTGGGGCCAGGGCACCCTGGT GACCGTGTCTAGCGGAGGCGGAGGATCTGGTGGCGGTGGATCTGGCGGCTCCGGAGGCTCCGAGATCGTGCTGACCCAGTCCCCTG GCACCCTGTCCCTGAGCCCTGGCGAGAGAGCCACCCTGTCTTGCCGGGCCTCCCAGTCCGTGTCCAACACCTACCTGGCCTGGTAT CAGAAGCCTGGCCAGGCCCCTCGGCTCCTGATCTACGGCGCCTCTTCCAGAGCCACCGGCATCCCTGACCGGTTCTCCGGCTCTGG CTCTGGCACCGACTTCACCCTGACCATCTCCAGCCTGGAACCCGAGGATTTCGCTGTGTACTATTGCCAGCAGTACTCCAACTCCT GGACCTTCGGACAGGGCACCAAGGTGGAAATCAAGTCC |
| 1892 | VH-VL of CDH19 65240.005 | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVTVSSGGGGSGGGGSGGGGSEIVLTQSPGTLSLSPGERATLSCRASQSVSNTYLAWYQ QKPGQAPRLLIYGASSRATGIPDRFSGSGSGTDFTLTISSLEPEDFAVYYCQQYSNSWTFGQGTKVEIKS |
| 1893 | CDH19 65240.005 x I2C | artificial | AA | QVQLVESGGGVVQPGGSLRLSCAASGFTFSSYDMHWVRQAPGKGLEWVAVISYEGTNEYYAESVKGRFTISRDTSKNTLYLQMNSL RAEDTAVYYCARERYFDWSFDYWGQGTLVTVSSGGGGSGGGGSGGGGSEIVLTQSPGTLSLSPGERATLSCRASQSVSNTYLAWYQ QKPGQAPRLLIYGASSRATGIPDRFSGSGSGTDFTLTISSLEPEDFAVYYCQQYSNSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 1894 | CDR-H1 of CDH19 65246.004 | artificial | AA | SYFIH |

TABLE VI-continued

| SEQ ID NO. | DESIGNATION | SOURCE | TYPE | SEQUENCE |
|---|---|---|---|---|
| 1895 | CDR-H2 of CDH19 65246.004 | artificial | AA | IINPISVSTSYAQKFQG |
| 1896 | CDR-H3 of CDH19 65246.004 | artificial | AA | GGIQLWLHFDY |
| 1897 | CDR-L1 of CDH19 65246.004 | artificial | AA | SGSSSNIGSNFVN |
| 1898 | CDR-L2 of CDH19 65246.004 | artificial | AA | TNNQRPS |
| 1899 | CDR-L3 of CDH19 65246.004 | artificial | AA | ATWDESLQGWV |
| 1900 | VH of CDH19 65246.004 | artificial | NT | CAGGTCCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGGCCTGGAATGGATGGGCATCATCAACCCTATCTCCGTGTCCA CCTCCTACGCCCAGAAATTCCAGGGCAGAGTGACCATGACCCGGGACACCTCCACCTCCACCGTGTACATGGAACTGTCTCCCTG CGGAGCGAGGACACCGCCGTGTACTACTGCGCCCAGAGGCCGGTAGTGGCCACTTGCACTTGCTGGGGCCAGGGCACCCT GGTCACCGTGTCTAGC |
| 1901 | VH of CDH19 65246.004 | artificial | AA | QVQLVQSGAEVKKPGASVKVSCKVSGYTFTSYFIHWVRQAPGQGLEWMGIINPISVSTSYAQKFQGRVTMTRDTSTSTVMELSSL RSEDTAVYYCARGGIQLWLHFDYWGQGTLVTVSS |
| 1902 | VL of CDH19 65246.004 | artificial | NT | CAGTCTGCCCTGACCCAGCCTCCTTCTGCCACCGGACCTGCCTCCCTGTCCCTGGGCCAGCGCGTGACCATCTCCTGCTCCGGCTCCTCCAACAT CGGCTCCAACTTCGTGAACTGGTACCAGCAGCTGCCCGGCACCGCCCCCAAGGTGCTGATCTACACCAACAACCAGCGGCCCTCCG GCGTGCCCGACCGGTTCTCTGGCTCCAAGTCTGGCACCTCCGCCAGTCTGGCCATCTCCGGCCTGCAGTCCGAGGACGAGGCCGAC TACTACTGTGCCACCTGGGACAGTCCCTGCAGGGCTGGGTGTTCGGCGGAGGCACCAAGCTGACCGTGCTGTCC |
| 1903 | VL of CDH19 65246.004 | artificial | AA | QSALTQPPSATGPGQRVTISCSGSSSNIGSNFVNWYQQLPGTAPKVLIYTNNQRPSGVPDRFSGSKSGTSASLAISGLQSEDEAD YYCATWDESLQGWVFGGGTKLTVLS |
| 1904 | VH-VL of CDH19 65246.004 | artificial | NT | CAGGTCCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGGCCTGGAATGGATGGGCATCATCAACCCTATCTCCGTGTCCA CCTCCTACGCCCAGAAATTCCAGGGCAGAGTGACCATGACCCGGGACACCTCCACCTCCACCGTGTACATGGAACTGTCTCCCTG GGATGCGAGGACACCGCCGTGTACTACTGCGCCCAGAGGCGGTATCTGGTGGCGTGGTTCTCGGCTGCCACTTGTCCCTGACCCAGCCTCCTT CTGCCACCGGACCTGGCCAGCGCGTGACCATCTCCTGCTCCGGCTCCAACATCGGCTCCAACTTCGTGAACTGGTAC CAGCAGCTGCCCGGCACCGCCCCCAAGGTGCTGATCTACACCAACAACCAGCGGCCCTCCGGCGTGCCCGACCGGTTCTCTGGCTC CAAGTCTGGCACCTCCGCCAGTCTGGCCATCTCCGGCCTGCAGTCCGAGGACGAGGCCGACTACTACTGTGCCACCTGGGACGAGT CCCTGCAGGGCTGGGTGTTCGGCGGAGGCACCAAGCTGACCGTGCTGTCC |
| 1905 | VH-VL of CDH19 65246.004 | artificial | AA | QVQLVQSGAEVKKPGASVKVSCKVSGYTFTSYFIHWVRQAPGQGLEWMGIINPISVSTSYAQKFQGRVTMTRDTSTSTVMELSSL RSEDTAVYYCARGGIQLWLHFDYWGQGTLVTVSSGGGGSGGGGSGGGGSQSALTQPPSATGPGQRVTISCSGSSSNIGSNFVNWY QQLPGTAPKVLIYTNNQRPSGVPDRFSGSKSGTSASLAISGLQSEDEADYYCATWDESLQGWVFGGGTKLTVLS |

TABLE VI-continued

| SEQ ID NO. | DESIGNATION | SOURCE | TYPE | SEQUENCE |
|---|---|---|---|---|
| 1906 | CDH19 65246.004 x I2C | artificial | AA | QVQLVQSGAEVKKPGASVKVSCKVSGYTFTSYFIHWVRQAPGQGLEWMGIINPISVSTSYAQKFQGRVTMTRDTSTSTVYMELSSL RSEDTAVYYCARGGIQLWLHFDYWGQGTLVTVSSGGGGSGGGGSGGGGSQSALTQPPSATGTPGQRVTISCSGSSSNIGSNFVNWY QQLPGTAPKVLIYTNNQRPSGVPDRFSGSKSGTSASLAISGLQSEDEADYYCATWDESLQGMVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1907 | CDR-H1 of CDH19 65247.004 | artificial | AA | SYFIH |
| 1908 | CDR-H2 of CDH19 65247.004 | artificial | AA | IINPISVSTSYAQKFQG |
| 1909 | CDR-H3 of CDH19 65247.004 | artificial | AA | GGIQLWLHLDY |
| 1910 | CDR-L1 of CDH19 65247.004 | artificial | AA | SGSSSNIGSNFVN |
| 1911 | CDR-L2 of CDH19 65247.004 | artificial | AA | TNNQRPS |
| 1912 | CDR-L3 of CDH19 65247.004 | artificial | AA | ATYDESMQGWV |
| 1913 | VH of CDH19 65247.004 | artificial | NT | CAGGTGCAGCTGGTGCAGTCTGGCGCGGAAGTGAAGAAACCTGGCGCCTCCGTGAAGGTGTCCTGCAAGGTGTCCGGCTACACCTT CACCTCCTACTTCATCCACTGGGTCCGACAGGCCCCAGGCCAGGGACTGGAATGGATGGGCATCATCAACCCTATCTCCGTGTCCA CCTCCTACGCCCAGAAATTCCAGGGCAGAGTGACCATGACCCGGGACACCTCCACCTCCACCGTGTACATGGAACTGTCCTCCCTG CGGAGCGAGGACACCGCCGTGTACTACTGCGCCAGAGGCGGCATCCAGCTGTGGCTGCACCTGGACTATTGGGGCCAGGGCACCCT GGTCACCGTGTCCTCT |
| 1914 | VH of CDH19 65247.004 | artificial | AA | QVQLVQSGAEVKKPGASVRVSCKVSGYTFTSYFIHWVRQAPGQGLEWMGIINPISVSTSYAQKFQGRVTMTRDTSTSTVYMELSSL RSEDTAVYYCARGGIQLWLHLDYWGQGTLVTVSS |
| 1915 | VL of CDH19 65247.004 | artificial | NT | CAGTCTGCCCTGACCCAGCCTCCTTCCGCTACCGGCACCCCTGGCCAGCGCGTGACCATCTCCTGCTCCGGCTCCTCCTCCAACAT CGGCTCCAACTTCGTGAACTGGTACCAGCAGCTGCCCGGCACCGCCCCCAAGGTGCTGATCTACACCAACAACCAGCGGCCCTCCG GCGTGCCCGACCGGTTCTCTGGCTCCAAGTCTGGCACCTCCGCTAGCCTGGCTATCTCCGGCCTCCAGTCCGAGGACGAGGCCGAC TACTACTGTGCCACCTACGACGAGTCCATGCAGGGCTGGGTGTTCGGCGGAGGCACCAAGCTGACCGTGCTGTCC |
| 1916 | VL of CDH19 65247.004 | artificial | AA | QSALTQPPSATGTPGQRVTISCSGSSSNIGSNFVNWYQQLPGTAPKVLIYTNNQRPSGVPDRFSGSKSGTSASLAISGLQSEDEAD YYCATYDESMQGWVFGGGTKLTVLS |
| 1917 | VH-VL of CDH19 65247.004 | artificial | NT | CAGGTGCAGCTGGTGCAGTCTGGCGCCGAAGTGAAGAAACCTGGCGCCTCCGTGAAGGTGTCCTGCAAGGTGTCCGGCTACACCTT CACCAGCTACTTCATCCACTGGGTCCGACAGGCCCCAGGCCAGGGCCTGGAATGGATGGGCATCATCAACCCTATCTCCGTGTCCA CCTCCTACGCCCAGAAATTCCAGGGCAGAGTGACCATGACCCGGGACACCTCCACCTCCACCGTGTACATGGAACTGTCCCTG |

TABLE VI-continued

| SEQ ID NO. | DESIGNATION | SOURCE | TYPE | SEQUENCE |
|---|---|---|---|---|
| 1918 | VH-VL of CDH19 65247.004 | artificial | AA | CGGAGCCAGGAGGACACCCGCTGTACTACTGCGCCAGAGGCGCATCCAGCTGTGGCTGCACCTGGACTATTGGGGCCAGGGCACCCT GGTCACCGTGTCCTCTGGTGGCGGAGGATCTGGCGGAGGTGGAAGCGGAGGCGGCGGATCTCAGTCTGCCCTGACCCAGCCTCCTT CCGCTACCGGCCACCCTGGCCACCCGCCCCTCCCGCCTCCTGCTCCGTGACCATCTCCTGCACTGGCTCCAACTTCGTGAACTGGTAC CAGCAGCTGCCCGGCACCGCCCCCAAGGTGCTACACACAGCCGTCTGATCTACACCAACAACAAGCGCCCTCCGGCGTTCTCTGGCTC CAAGTCTGGCAACACCGCCAGCCTGACCATCTCCGGCCTGCAGGCTGAGGACGAGGCCGACTACTACTGTGCCACCTACGACGAGT CCATGCAGGGCTGGGTGTTCGGCGGAGGCACCCAAGCTGACCGTGCTGTCC |
| | | | AA | QVQLVQSGAEVKKPGASVRVSCKVSGYTFTSYFIHWVRQAPGQGLEWMGIINPISVSTSYAQKFQGRVTMTRDTSTSTVYMELSSL RSEDTAVYYCARGIQLWLHLDYWGQGTLVTVSSGGGGSGGGGSGGGGSQSALTQPPSATGTPGQRVTISCSGSSSNIGSNFVNWY QQLPGTAPKVLIYTNNQRPSGVPDRFSGSKSGTSASLAISGLQSEDEADYYCATYDESMQGWVFGGGTKLTVLS |
| 1919 | CDH19 65247.004 x I2C | artificial | AA | QVQLVQSGAEVKKPGASVRVSCKVSGYTFTSYFIHWVRQAPGQGLEWMGIINPISVSTSYAQKFQGRVTMTRDTSTSTVYMELSSL RSEDTAVYYCARGIQLWLHLDYWGQGTLVTVSSGGGGSGGGGSGGGGSQSALTQPPSATGTPGQRVTISCSGSSSNIGSNFVNWY QQLPGTAPKVLIYTNNQRPSGVPDRFSGSKSGTSASLAISGLQSEDEADYYCATYDESMQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHH |
| 1920 | CDR-H1 of CDH19 65249.002 | artificial | AA | GYYWS |
| 1921 | CDR-H2 of CDH19 65249.002 | artificial | AA | YIYYIGSTNYNPSLKS |
| 1922 | CDR-H3 of CDH19 65249.002 | artificial | AA | DGSSGWYRWFDP |
| 1923 | CDR-L1 of CDH19 65249.002 | artificial | AA | RASQSVSSSYLA |
| 1924 | CDR-L2 of CDH19 65249.002 | artificial | AA | GASSRAT |
| 1925 | CDR-L3 of CDH19 65249.002 | artificial | AA | QQYGNSPLT |
| 1926 | VH of CDH19 65249.002 | artificial | NT | CAGGTGCAGCTGCAGGAATCCGGCCCTGGCCTGGTCAAGCCCTCTGAGACACTGTCCCTGACCTGCACCGTTCCGGCGGCTCCAT CTCCGGCTACTACTGGTCCTGGATCCGGCAGCCCCCTGGCAAGGCTGGAATGGATCGGCTACATCTACTACATCGGCTCCACCA ACTACAACCCCAGCCTGAAGTCCGTACGTCACCCAGAGTGACCATGTCCGTGGACACCAGTTCTCCCTGAAGCTCTCCGTGACC GCCGCTGACACCGCCGTGTACTACTGCGCCAGAGATGGCTCTCCGGGTGGTATCGTTGGTTCGACCCTTGGGGCCAGGGCACCCT GGTCACCGTGTCTAGC |
| 1927 | VH of CDH19 65249.002 | artificial | AA | QVQLQESGPGLVKPSETLSLTCTVSGGSISGYYWSWIRQPPGKGLEWIGYIYYIGSTNYNPSLKSRVTMSVDTSKNQFSLKLSSVT AADTAVYYCARDGSSGWYRWFDPWGQGTLVTVSS |

TABLE VI-continued

| SEQ ID NO. | DESIGNATION | SOURCE | TYPE | SEQUENCE |
|---|---|---|---|---|
| 1928 | VL of CDH19 65249.002 | artificial | NT | GAGATCGTGCTGACCCAGTCCCCTGGCACCCTGTCCCTGAGCCCTGGCGAGAGAGCCACCCTGTCCTGCAGAGCCTCCCAGTCCGT GTCCTCCTACTACTGGCTTGGTATCAGCAGAAGCCCGGCCAGGCCCCTAGGCTCCTGATCTTCGGCGCTCTTCCGAGAGCCACCG GCATCCCTGACCGGTTCTCCGGCTCCGGCACCGACTTCACCCTGACCATCTCCCGGCTGGAACCCGAGGACTTCGCTGTG TACTACTGCCAGCAGTACGGCAACAGCCCCCTGACCTTCGGCCAGGCACCAAGGTGGAAATCAAGTCC |
| 1929 | VL of CDH19 65249.002 | artificial | AA | EIVLTQSPGTLSLSPGERATLSCRASQSVSSSYLAWYQQKPGQAPRLLIFGASSRATGIPDRFSGSGSGTDFTLTISRLEPEDFAV YYCQQYGNSPLTFGQGTKVEIKS |
| 1930 | VH-VL of CDH19 65249.002 | artificial | NT | CAGGTGCAGCTGCAGGAATCCGGCCTGGCCTGGTCAAGCCCTGGCCCCCTGGCTCCAGCCCCTGGAATGGATCGGCTACATCTACTATAGCGGCTCCACCA ACTACAACCCCAGCCTGAAGTCCAGAGTGACCATGTCCGTGGACACCTCCAAGAACCAGTTCTCCCTGAAGCTGTCCTCCGTGACC GCCGCTGACACCGCCGTGTACTACTGCGCCAGAGATGGCTCCTCCGGCTATCGTGGTTCGACCCTTTGGGGCCAGGGCACCCT GGTCACCGTGTCTAGCGGAGGCGGAGGATCTGGTGGCGGAGGCTCCGGAGGTGGTGGCCAGTCCCGCCCCTG GCACCCTGTCCCTGAGCCCTGGAGGCCGAGCCACCCTGATCCTGCGCCAGCCATTGCGGCCTGATCTCCCAGATCTCCCCCAGCTC CAGCAGAAGCCCGGCCAGGCCCCTCACCCTGATCTTCGGCGCTCTTCCAGAGCACACCGGCATCCCTGACCGGTTCTCCGGCTC TGGCTCCGGCACCGACTTCACCCTGACCATCTCCCGGCTGGAACCCGAGGACTTCGCTGTGTACTACTGCCAGCAGTACGGCAACA GCCCCCTGACCTTCGGCCAAGGCACCAAGGTGGAAATCAAGTCC |
| 1931 | VH-VL of CDH19 65249.002 | artificial | AA | QVQLQESGPGLVKPSETLSLTCTVSGGSISGYYWSWIRQPPGKGLEWIGYIYYIGSTNYNPSLKSRVTMSVDTSKNQFSLKLSSVT AADTAVYYCARDGSSGMYRWFDPWGQGTLVTVSSGGGGSGGGGSGGGGSETVLTQSPGTLSLSPGERATLSCRASQSVSSSYLAWY QQKPGQAPRLLIFGASSRATGIPDRFSGSGSGTDFTLTISRLEPEDFAVYYCQQYGNSPLTFGQGTKVEIKS |
| 1932 | CDH19 65249.002 x I2C | artificial | AA | QVQLQESGPGLVKPSETLSLTCTVSGGSISGYYWSWIRQPPGKGLEWIGYIYYIGSTNYNPSLKSRVTMSVDTSKNQFSLKLSSVT AADTAVYYCARDGSSGMYRWFDPWGQGTLVTVSSGGGGSGGGGSEIVLTQSPGTLSLSPGERATLSCRASQSVSSSYLAWY QQKPGQAPRLLIFGASSRATGIPDRFSGSGSGTDFTLTISRLEPEDFAVYYCQQYGNSPLTFGQGTKVEIKSGGGGSEVQLVESGG GLVQPGGSLKLSCAASGFTFNKYAMNWVRQAPGKGLEWVARIRSKYNNYATYYADSVKDRFTISRDDSKNTAYLQMNNLKTEDTAV YYCVRHGNFGNSYISYWAYWGQGTLVTVSSGGGGSGGGGSGGGGSQTVVTQEPSLTVSPGGTVTLTCGSSTGAVTSGNYPNWVQQK PGQAPRGLIGGTKFLAPGTPARFSGSLLGGKAALTLSGVQPEDEAEYYCVLWYSNRWVFGGGTKLTVLHHHHHH |
| 1933 | CDR-H1 of CDH19 65250.003 | artificial | AA | SYYMS |
| 1934 | CDR-H2 of CDH19 65250.003 | artificial | AA | IIHPSGDTTYAQKFQG |
| 1935 | CDR-H3 of CDH19 65250.003 | artificial | AA | GGIKLWLHFDY |
| 1936 | CDR-L1 of CDH19 65250.003 | artificial | AA | SGSRSNIGSNFVN |
| 1937 | CDR-L2 of CDH19 65250.003 | artificial | AA | TNNQRPS |

TABLE VI-continued

| SEQ ID NO. | DESIGNATION | SOURCE | TYPE | SEQUENCE |
|---|---|---|---|---|
| 1938 | CDR-L3 of CDH19 65250.003 | artificial | AA | AVYDDSLNGWV |
| 1939 | VH of CDH19 65250.003 | artificial | NT | CAGGTGCAGCTGGTGCAGTCTGGGCGCCGAAGTGAAGAAACCTGGCGCCTCCGTGAAGGTGTCCTGCAAGGCCTCCGGATACACCTT CACCAGCTACTACATGTCCTGGGTCCGACAGGCCCCAGGCCAGGGCCTGGAATGGATGGGCATATCCACCCCTCTGGCGGCGACA CCACCTACGCCCAGAAATTCCAGGGCAGAGTGACCATGACCCGGGACACCTCCACCTCCACCGTGTATATGGAACTGTCCTCCTG CGGAGCGAGGACACCGCCGTGTACTACTGCGCCCGTGTACTACTGCGCCGAGGACGAGGCCCT GGTCACCGTGTCTAGC |
| 1940 | VH of CDH19 65250.003 | artificial | AA | QVQLVQSGAEVKKPGASVKVSCKASRYTFTSYYMSWVRQAPGQGLEWMGIIHPSGDTTYAQKFQGRVTMTGDTSTSTVYMELSSL RSEDTAVYYCARGIKLWLHFDYWGQGTLVTVSS |
| 1941 | VL of CDH19 65250.003 | artificial | NT | CAGTCCGTGCTGACCCAGCCTCCTTCCGCTTCCGGCACCCCTGGCCAGCGCGTGACCATCTCCTGCTCCGGCTCCCGGTCCAACAT CGGCTCCAACTTCGTGAACTGGTATCAGCAGCTGCCCGGCACCGCCCCCAAGCTGCTGATCTACGACGACAGCCTGAATGGCCCTCCG GCGTGCCCGACCGGTTCTCTGGCTCCAAGTCTGGCACCTCCGCCTCCATCTCCGGCCTGCAGTCTGAGGACGAGGCCGAC TACTACTGCGCCGTGTACGACGACTCCCTGAACGGCTGGGTGTTCGGCGGAGGCACCAAGCTGACCGTGCTGTCC |
| 1942 | VL of CDH19 65250.003 | artificial | AA | QSVLTQPPSASGTPGQRVTISCSGSRSNIGSNFVNWYQQLPGTAPKLLIYTNNQRPSGVPDRFSGSKSGTSASLAISGLQSEDEAD YYCAVYDDSLNGWVFGGGTKLTVLS |
| 1943 | VH-VL of CDH19 65250.003 | artificial | NT | CAGGTGCAGCTGGTGCAGTCTGGGCGCCGAAGTGAAGAAACCTGGCGCCTCCGTGAAGGTGTCCTGCAAGGCCTCCGGATACACCTT CACCAGCTACTACATGTCCTGGGTCCGACAGGCCCCAGGCCAGGGCCTGGAATGGATGGGCATATCCACCCCTCTGGCGGCGACA CCACCTACGCCCAGAAATTCCAGGGCAGAGTGACCATGACCCGGGACACCTCCACCTCCACCGTGTATATGGAACTGTCCTCCTG GGTCACCGTGTCTAGCGGCGGAGGATCTGGTGGCGGTGGTTCTGGCGGCGGAGGCTCCGGTCCAACATCGGCTCCAACTTCGTGAA CGGGTTCTCCGGCTCCAAGTCTGGCACCTCCGCCTCCATCTCCGGCCTGCAGTCTGAGGACGAGGCCGACTACTACTGCGCCGTGTAT GACGACTCCCTGAACGGCTGGGTGTTCGGCGGAGGCACCAAGCTGACCGTGCTGTCC |
| 1944 | VH-VL of CDH19 65250.003 | artificial | AA | QVQLVQSGAEVKKPGASVKVSCKASRYTFTSYYMSWVRQAPGQGLEWMGIIHPSGDTTYAQKFQGRVTMTGDTSTSTVYMELSSL RSEDTAVYYCARGIKLWLHFDYWGQGTLVTVSSGGGGSGGGGSGGGGSQSVLTQPPSASGTPGQRVTISCSGSRSNIGSNFVNWY QQLPGTAPKLLIYTNNQRPSGVPDRFSGSKSGTSASLAISGLQSEDEADYYCAVYDDSLNGWVFGGGTKLTVLS |
| 1945 | CDH19 65250.003 x I2C | artificial | AA | QVQLVQSGAEVKKPGASVKVSCKASRYTFTSYYMSWVRQAPGQGLEWMGIIHPSGDTTYAQKFQGRVTMTGDTSTSTVYMELSSL RSEDTAVYYCARGIKLWLHFDYWGQGTLVTVSSGGGGSGGGGSGGGGSQSVLTQPPSASGTPGQRVTISCSGSRSNIGSNFVNWY QQLPGTAPKLLIYTNNQRPSGVPDRFSGSKSGTSASLAISGLQSEDEADYYCAVYDDSLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDDAEYYCVLWYSNRWVFGGGTKLTVLHHHHHH |
| 1946 | CDR-H1 of CDH19 65250.004 | artificial | AA | SYYMS |
| 1947 | CDR-H2 of CDH19 65250.004 | artificial | AA | IIHPSGDTTYAQKFQG |

TABLE VI-continued

| SEQ ID NO. | DESIGNATION | SOURCE | TYPE | SEQUENCE |
|---|---|---|---|---|
| 1948 | CDR-H3 of CDH19 65250.004 | artificial | AA | GGIKLMLHFDY |
| 1949 | CDR-L1 of CDH19 65250.004 | artificial | AA | SGSRSNIGSNFVN |
| 1950 | CDR-L2 of CDH19 65250.004 | artificial | AA | TNNQRPS |
| 1951 | CDR-L3 of CDH19 65250.004 | artificial | AA | AVYDESLQGWV |
| 1952 | VH of CDH19 65250.004 | artificial | NT | CAGGTCAGCTGGTGCAGTCTGGCGCCGAAGTGAAGAAACCTGGCGCCTCCGTGAAGGTGTCCTGCAAGGCTTCCGGGTACACCTTCACCAGCTACTACATGTCCTGGGTCCGACAGGCCCCAGGCCAGGGCCTGGAATGGATGGGCATCATCCACCCCTCTGGCGCGGACACCCACTTACGCCCAGGGCAGAGTGACCATGACCGCCGACATGAGCACCTCCACCGTGTATATGGAACTGTCCTCCCTGCGGAGCGAGGACACCGCCGTGTACTACTGCGCCAGAGGCGGCATCAAGCTGATGCTGCACTTCGACTACTGGGGCCAGGGCACCCTGGTCACCGTGTCTAGC |
| 1953 | VH of CDH19 65250.004 | artificial | AA | QVQLVQSGAEVKKPGASVKVSCKASGYTFTSYYMSWVRQAPGQGLEWMGIIHPSGDTTYAQKFQGRVTMTGDTSTSTVMELSSLRSEDTAVYYCARGGIKLMLHFDYWGQGTLVTVSS |
| 1954 | VL of CDH19 65250.004 | artificial | NT | CAGTCCGTGCTGACCCAGCCTCCTTCCGCTTCCGGCTCCACCCCTGGCCAGCGCGTGACCATCTCCTGTTCCGGTTCCAACAATCGGCTCCAACTTCGTGAACTGGTATCAGCAGCTGCCAGGAACCGCCCCCAAGCTGCTGATCTACACCAACAACCAGCGCCCCTCCGGCGTGCCCGACCGGTTCTCTGGCTCCAAGTCTGGCACCTCCGCCTCCATCTCCGGCCTGCAGTCTGAAGACGAGGCCGACTACTACTGCGCCGTGTACGACGAGTCCCTGCAGTGGGTGTTCGGCGGAACAAAGCTGACCGTGCTGTCC |
| 1955 | VL of CDH19 65250.004 | artificial | AA | QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLS |
| 1956 | VH-VL of CDH19 65250.004 | artificial | NT | CAGGTCAGCTGGTGCAGTCTGGCGCCGAAGTGAAGAAACCTGGCGCCTCCGTGAAGGTGTCCTGCAAGGCTTCCGGGTACACCTTCACCAGCTACTACATGTCCTGGGTCCGACAGGCCCCAGGCCAGGGCCTGGAATGGATGGGCATCATCCACCCCTCTGGCGCGGACACCCACTTACGCCCAGGGCAGAGTGACCATGACCGCCGACACTAAGTCTGCACTTCGACTACTGGGGCCAGGGCACCCTGGTCACCGTGTCTTCCGGCGGAGGCGGATCTGGCGGAGGCGGAAGTGGTGGCGGTGGTTCTGGCGGCGGCGGATCCCAAGCTCCGTGCTGACACAGCCTCCTGCCTCCGGCACACCCGGACAGCGCGTGACCATCTCCTGTAGCGGCTCCCGGTCCAACATCGGCTCCAACTTCGTGAACTGGTACCAGCAGCTGCCCGGCACCGCCCCCAAGCTGCTCATCTACACCAACAACCAGCGGCCTAGCGGCGTGCCCGACCGGTTCTCTGGCTCCAAGTCTGGCACCTCCGCCAGCCTGGCCATCTCCGGCCTGCAGTCCGAGGACGAGGCCGACTACTACTGCGCCGTGTACGACGAGTCCCTGCAGTGGGTGTTCGGCGGAGGCACCAAGCTGACCGTGCTGTCC |
| 1957 | VH-VL of CDH19 65250.004 | artificial | AA | QVQLVQSGAEVKKPGASVKVSCKASGYTFTSYYMSWVRQAPGQGLEWMGIIHPSGDTTYAQKFQGRVTMTGDTSTSTVMELSSLRSEDTAVYYCARGGIKLMLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLS |
| 1958 | CDH19 65250.004 x I2C | artificial | AA | QVQLVQSGAEVKKPGASVKVSCKASGYTFTSYYMSWVRQAPGQGLEWMGIIHPSGDTTYAQKFQGRVTMTGDTSTSTVMELSSLRSEDTAVYYCARGGIKLMLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDT |

TABLE VI-continued

| SEQ ID NO. | DESIGNATION | SOURCE | TYPE | SEQUENCE |
|---|---|---|---|---|
| 1959 | CDR-H1of CDH19 65250.005 | artificial | AA | AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1960 | CDR-H2 of CDH19 65250.005 | artificial | AA | SYYMS |
| 1961 | CDR-H3 of CDH19 65250.005 | artificial | AA | IIHPSGGDTTYAQKFQG |
| 1962 | CDR-L1 of CDH19 65250.005 | artificial | AA | GGIKLWLHFDY |
| 1963 | CDR-L2 of CDH19 65250.005 | artificial | AA | SGSRSNIGSNFVN |
| 1964 | CDR-L3 of CDH19 65250.005 | artificial | AA | TNNQRPS |
| 1965 | VH of CDH19 65250.005 | artificial | AA | AVYDESLQGWV |
| 1966 | VH of CDH19 65250.005 | artificial | NT | CAGGTGCAGCTGGTGCAGTCTGGCGCCGAAGTGAAGAAACCTGGCGCCTCCGTGAAGGTGTCCTGCAAGGCCTCCGGGTACACCTT CACCAGCTACTACATGTCCTGGGTCCGACAGGCCCCTGGAATGGCATGGCATCATCCACCCTCTGGCGGCGACA CCACCTACGCCCAGAAATTCCAGGGCAGAGTGACCATGACCCGGGACACCTCCACCTGTATATGAACTGTCCTCCTG CGGAGCGAGGACACCGCCGTGTACTACTGCGCCAGAGGCGGCATCAAGCTGTGGCTGCACTTCGACTACTGGGGCCAGGGCACCCT GGTCACCGTGTCTAGC |
| 1967 | VL of CDH19 65250.005 | artificial | AA | QVQLVQSGAEVKKPGASVKVSCKASGYTFTSYYMSWVRQAPGQGLEWMGIIHPSGDTTYAQKFQGRVTMTRDTSTVMELSSL RSEDTAVYYCARGGIKLWLHFDYWGQGTLVTVSS |
| 1968 | VL of CDH19 65250.005 | artificial | NT | CAGTCCGTGCTGACCCAGCCTCCTTCCGCCTCCGGGTCTCCGGCACCCCTGGCCATCCTGTCTGGCTCCAACAT CGGCTCCAACTTCGTGAACTGGTATCAGCAGCTGCCCGGCACCGCCCCAAGCTGCTGATCTACACCAACAACCAGCGGCCCTCCG GCGTGCCCGACCGGTTCTCTGGCTCCAAGTCTGGCACCTCGGGGAGCACGAGTCCCTGCCAATCTGAGGACGAGGCCGAC TACTACTGTGCCGTGTACGACGAGTCCCTGCAGGGCTGTTCGGCGGAGGCACCAAGCTGACCGTGCTC |
| 1969 | VL of CDH19 65250.005 | artificial | AA | QSVLTQPPSASGTPGQRVTISCSGSRSNIGSNFVNWYQQLPGTAPKLLIYTNNQRPSGVPDRFSGSKSGTSASLAISGLQSEDEAD YYCAVYDESLQGWVFGGGTKLTVLS |
| 1969 | VH-VL of CDH19 65250.005 | artificial | NT | CAGGTGCAGCTGGTGCAGTCTGGCGCCGAAGTGAAGAAACCTGGCGCCTCCGTGAAGGTGTCCTGCAAGGCCTCCGGGTACACCTT CACCAGCTACTACATGTCCTGGGTCCGACAGGCCCCTGGAATGGATGGGCATCATCCACCCTCTGGCGGCGACA CCACCTACGCCCAGAAATTCCAGGGCAGAGTGACCATGACCCGGGACACCTCCACCGTGTATATGAACTGTCCTCCTG CGGAGCGAGGACACCGCCGTGTACTACTGCGCCAGAGGCGGCATCAAGCTGTGGCTGCACTTCGACTACTGGGGCCAGGGCACCCT GGTCACCGTGTCTAGCGGAGGCGGAGGATCTGGCGGCGGAGGTTCTGGCGGCGGAGGCTCCAGTCCGTGCTGACCCAGCCTCCT TCCGCCTCCGGCACCCCTGGCCAGCGCGTGACCATCTCTGCTCCGGCAGCCGGAGCAACATCGGCTCCAACTTCGTGAACTGGTAT CAGCAGCTGCCCGGCACCGCCCCCAAGCTGCTGATCTACACCAACAACCAGCGGCCCTCCGGCGTGCCCGACCGGTTCTCTGGCTC |

TABLE VI-continued

| SEQ ID NO. | DESIGNATION | SOURCE | TYPE | SEQUENCE |
|---|---|---|---|---|
| 1970 | VH-VL of CDH19 65250.005 | artificial | AA | CAAGTCTGGACCACCTCCGCTCCCTGGCCATTCCGGCCTGCAGTCTGAGGACGAGGCCGACTACTACTGTGCCGTGACGAGT CCCTGCAGGGCTGGGTTCGGCGGAGGCACCAAGCTGACCGTGCTGTCC QVQLVQSGAEVKKPGASVKVSCKASGYTFTSYYMSWVRQAPGQGLEWMGIIHPSGDTTYAQKFQGRVTMTRDTSTSTVMELSSL RSEDTAVYYCARGGIKLWLHFDYWGQGTLVTVSSGGGGSGGGGSGGGGSQVLTQPPSASGTPGQRVTISCSGSRSNIGSNFVNWY QQLPGTAPKLLIYTNNQRPSGVPDRFSGSKSGTSASLAISGLQSEDEADYYCAVDESLQGWVFGGGTKLTVLS |
| 1971 | CDH19 65250.005 × I2C | artificial | AA | QVQLVQSGAEVKKPGASVKVSCKASGYTFTSYYMSWVRQAPGQGLEWMGIIHPSGDTTYAQKFQGRVTMTRDTSTSTVMELSSL RSEDTAVYYCARGGIKLWLHFDYWGQGTLVTVSSGGGGSGGGGSGGGGSQVLTQPPSASGTPGQRVTISCSGSRSNIGSNFVNWY QQLPGTAPKLLIYTNNQRPSGVPDRFSGSKSGTSASLAISGLQSEDEADYYCAVDESLQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 1972 | CDR-H1 of CDH19 65251.002 | artificial | AA | NYYMS |
| 1973 | CDR-H2 of CDH19 65251.002 | artificial | AA | IINPSGGDSTYAQKFQG |
| 1974 | CDR-H3 of CDH19 65251.002 | artificial | AA | GGIQLWLHFDY |
| 1975 | CDR-L1 of CDH19 65251.002 | artificial | AA | SGSRSNIGSNFVN |
| 1976 | CDR-L2 of CDH19 65251.002 | artificial | AA | TNYQRPS |
| 1977 | CDR-L3 of CDH19 65251.002 | artificial | AA | AVWDESLNGWV |
| 1978 | VH of CDH19 65251.002 | artificial | NT | CAGGTGCAGCTGGTGCAGTCTGGCGCCGAAGTGAAGAAACCTGGCGCCTCCGTGAAGGTGTCCTGCAAGGCCTCCGGCTACACCTT CACCAGCTACTACATGTCCTGGGTCCGACAGGCCCCAGGCCAGGGCCTGGAATGATGGCCATCATCAACCCTCTGGCGCGACT CACCTACGCCCAGAAGTTCCAGGGCCGGTCACTGTACTACGCCCAGTGACCATGACCCGCGACACCAGCACCAGCACCGTGATGGAACTGTCCTCCCTG CGGAGCGAGGACACCGCCGTGTACTACTGCGCCAGGGGCATCCAGCTGTGGCTGCACTTCGACTACTGGGGCCAGGGCACCCT GGTCACCGTGTCTAGC |
| 1979 | VH of CDH19 65251.002 | artificial | AA | QVQLVQSGAEVKKPGASVKVSCKASRYTFTNYYMSWVRQAPGQGLEWMGIINPSGGDSTYAQKFQGRLTMTGDTSTSTVMELSSL RSEDTAVYYCARGIQLWLHFDYWGQGTLVTVSS |
| 1980 | VL of CDH19 65251.002 | artificial | NT | CAGTCTGTGCTGACCCAGCCCCTTCCGCTCTGGCACCCTGGCCAGAAAGTGACCATCTCCTGCTCCGGTCCCGGTCCAACAT GGCTCCAACTTCGTGAACTGGTATCAGCAGCTGCCCGGCACCGCCCCCAAGCTGCTGATCTACACCAACTACCAGCGCCCTCCG GCTTCGGCCCCGACCGGTTCTCTGGCTCCAAGTCTGGCACCTCCGCCTCCCTGGCCATTCCGGCGCAGTGCAGTCCGAGGACGAGGCCGAC TACTACTGTGCCGTGTGGGACGAGTCCCTGAACGGCTGGGTGTTCGGCGGAGGCACCAAGCTGACCGTGCTGTCC |

TABLE VI-continued

| SEQ ID NO. | DESIGNATION | SOURCE | TYPE | SEQUENCE |
|---|---|---|---|---|
| 1981 | VL of CDH19 65251.002 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD YYCAVWDESLNGWVFGGGTKLTVLS |
| 1982 | VH-VL of CDH19 65251.002 | artificial | NT | CAGGTGCAGCTGGTGCAGTCTGGGCGCCGAAGTGAAGAAACCTGGCCTCCGTGAAGGTGTCCTGCAAGGCCTCCGGCTACACCTT CACCAACTACTACATGTCCTGGGTCCGACAGGCCCAGGGCCAGGGCCTGGAATGGATGGCCATCATCAACCCTGCTGGCGACT CCACCTACGCCCAGAAGTTCCAGGGCCGGCTGACCATGACCCGTGACACTTCCACCGTGTATATGGAACTGTCCTCCCTG CGGAGCGAGGACACCGCCGTGTACTACTGCGCCAGAGCCGTTGGTGCGCGGTGTTCTGGCGGCGGCGGCAGCGGCGGTGGCGGAAGC GGTCACCGTGTCTAGCGGCGGAGGATCTGGTGGCGGTGGTTCTGGCGGCGGCTCCCAGTCTGTGCTGACCCAGCCCTT CCGCCTCTGGCCACCCGGCACCCCCTGGCCAGAAAGTGACCATCTCCTGTAGCGGCAGCCGGTCCAACATCGGCTCCAACTTCGTGAACTGGTAT CAGCAGCTGCCCGGCACCGCCCCCAAGCTGCTGATCTACACCAACTACCAGCGCCCTCCGGCGTGCCGACCGGTTCTCTGGCTC CAAGTCTGGCACCTCCGCCTCCCTGGCCATCTCCGGCCTGCAGTCTGAGGACGAGGCCGACTACTGTGCCGTGTGGGACGAGT CCCTGAACGGCTGGTGTTCGGCGGAGGCACCAAGCTGACCGTGCTGTCC |
| 1983 | VH-VL of CDH19 65251.002 | artificial | AA | QVQLVQSGAEVKKPGASVKVSCKASRYTFTNYYMSWVRQAPGQGLEWMGIINPSGDSTYAQKFQGRLTMTGDTSTSTVMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLNGWVFGGGTKLTVLS |
| 1984 | CDH19 65251.002 x I2C | artificial | AA | QVQLVQSGAEVKKPGASVKVSCKASRYTFTNYYMSWVRQAPGQGLEWMGIINPSGDSTYAQKFQGRLTMTGDTSTSTVMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTKFLAPGTPARFSGSLLGGKAAITLSGVQPEDEAEYYCVLWYSNRWVFGGGTKLTVLHHHHHH QKPGQAPRGLIGGTKFLAPGTPARFSGSLLGGKAAITLSGVQPEDEAEYYCVLWYSNRWVFGGGTKLTVLHHHHHH |
| 1985 | CDR-H1 of CDH19 65251.003 | artificial | AA | NYYMS |
| 1986 | CDR-H2 of CDH19 65251.003 | artificial | AA | IINPSGDSTYAQKFQG |
| 1987 | CDR-H3 of CDH19 65251.003 | artificial | AA | GGIQLWLHFDY |
| 1988 | CDR-L1 of CDH19 65251.003 | artificial | AA | SGSRSNIGSNFVN |
| 1989 | CDR-L2 of CDH19 65251.003 | artificial | AA | TNYQRPS |
| 1990 | CDR-L3 of CDH19 65251.003 | artificial | AA | AVWDESLQGWV |
| 1991 | VH of CDH19 65251.003 | artificial | NT | CAGGTGCAGCTGGTGCAGTCTGGGGCCGAAGTGAAGAAACCTGGCCTCCGTGAAGGTGTCCTGCAAGGCCTCCGGCTACACCTT CACCAACTACTACATGTCCTGGGTCCGACAGGCCCAGGGCCTGGAATGGATGGGCATCATCAACCCCTCTGGCGACT |

TABLE VI-continued

| SEQ ID NO. | DESIGNATION | SOURCE | TYPE | SEQUENCE |
|---|---|---|---|---|
| | | | | CCACCTACGCCCAGAAGTTCCAGGGCCGGTCTGACCATGACCGGCGACACCTCCACCTCACCGTGTATATGGAACTGTCCTCCTG<br>CGGAGCGGAGGACACCCGCGTGTACTACTGCGCCAGAGGCGGCATCCAGCTGATGCTGCACTTCGACTACTGGGGCCAGGGCACCCT<br>GGTCACCGTGTCTAGC |
| 1992 | VH of CDH19<br>65251.003 | artificial | AA | QVQLVQSGAEVKKPGASVKVSCKASRYTFTNYYMSWVRQAPGQGLEWMGIINPSGDSTYAQKFQGRLTMTGDTSTSTVYMELSSL<br>RSEDTAVYYCARGGIQLMLHFDYWGQGTLVTVSS |
| 1993 | VL of CDH19<br>65251.003 | artificial | NT | CAGTCTGTGCTGACCCAGCCCCCTTCCGCTTCTGGCACCCCTGGACAGAAGTGACCATCTCCTGCTCCGGCTCCAACAT<br>CGGCTCCAACTCTGTATCGACCAGCTGCCCGGCACCCCCAAGCTGCTACACCAGCGCCTTCCG<br>GCGTGCCCGACCGGTTCTCTGGCTCCAAGTCTGGCACCTCCGCCTCCCTGGCTATCTCCGGCCTCCAGGACGAGGCCGAC<br>TACTACTGTGCCGTGTGGGACGAGTCCCTGCAGGGCTGTTCGGCGGAGGCACCAAGCTGACCGTGCTGTCC |
| 1994 | VL of CDH19<br>65251.003 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD<br>YYCAVWDESLQGWVFGGGTKLTVLS |
| 1995 | VH-VL of<br>CDH19<br>65251.003 | artificial | NT | CAGGTGCAGCTGGTGCAGTCTGGCGCCGAAGTGAAGAAACCTGGCGCCTCCGTGAAGGTGTCCTGCAAGGCCTCCCGGTACACCTT<br>CACCAACTACTACATGTCCTGGGTCCGACAGGCCCCAGGCCAGGGCCTGGAATGGATGGGCATCATCAACCCCTCTGGCGACACT<br>CCACCTACGCCCAGAAGTTCCAGGGCCGGGTGACCATCACCGGCGACACCTCCACCTCACCGTGTATATGGAACTGTCCTCCTG<br>CGGAGCGAGGACACCGCCGTGTACTACTGCGCCAGAGGCGGCATGTGCCGGAGGCCCCCCCAGCAGCCTC<br>GGTCACCGTGTCTAGCGGAGGTGGAGGATCTGGTGGCGGAGGATCGGTGGCGGAGGAAGCTCTGCTCCAGGCCCCTT<br>CCGCCTCTGGCACCCCTGGCCAGAAGTGACCATCTCCTGCTCCGGCTCCAACATCGGCTCCAACTCTGTGAACTGGTAT<br>CAGCAGCTGCCCGGCACCGCCCCGCTCGCCCAAGCTGCTGCTGATCTACACCAACTACCAGCGCCCTCTGAGGACGAGGCCGACTACTACTGTGCCGTGTGGGACGAGT<br>CAAGTCTGGCACCTCCGCCTCCCTGGCTATCTCCGGCCTCCAGTCTGAGGACGAGGCCGACTACTACTGTGCCGTGTGGGACGAGT<br>CCCTGCAGGGCTGGGTGTTCGGCGGAGGCACCAAGCTGACCGTGCTGTCC |
| 1996 | VH-VL of<br>CDH19<br>65251.003 | artificial | AA | QVQLVQSGAEVKKPGASVKVSCKASRYTFTNYYMSWVRQAPGQGLEWMGIINPSGDSTYAQKFQGRLTMTGDTSTSTVYMELSSL<br>RSEDTAVYYCARGGIQLMLHFDYWGQGTLVTVSSGGGGSGGGGSGGGGSQVLTQPPSASGTPGQKVTISCSGSRSNIGSNFVNWY<br>QQLPGTAPKLLIYTNYQRPSGVPDRFSGSKSGTSASLAISGLQSEDEADYYCAVWDESLQGWVFGGGTKLTVLS |
| 1997 | CDH19<br>65251.003x<br>I2C | artificial | AA | QVQLVQSGAEVKKPGASVKVSCKASRYTFTNYYMSWVRQAPGQGLEWMGIINPSGDSTYAQKFQGRLTMTGDTSTSTVYMELSSL<br>RSEDTAVYYCARGGIQLMLHFDYWGQGTLVTVSSGGGGSGGGGSGGGGSQVLTQPPSASGTPGQKVTISCSGSRSNIGSNEVNWY<br>QQLPGTAPKLLIYTNYQRPSGVPDRFSGSKSGTSASLAISGLQSEDEADYYCAVWDESLQGWVFGGGTKLTVLSGGGGSEVQLVES<br>GGGLVQPGGSLKLSCAASGFTFNKYAMNWVRQAPGKGLEWVARIRSKYNNYATYYADSVKDRFTISRDDSKNTAYLQMNNLKTEDT<br>AVYYCVRHGNFGNSYISYWAYWGQGTLVTVSSGGGGSGGGGSGGGGSQTVVTQEPSLTVSPGGTVLTCGSSTGAVTSGNYPNWVQ<br>QKPGQAPRGLIGGTKFLAPGTPARFSGSLLGGKAALTLSGVQPEDEAEYYCVLWYSNRWVFGGGTKLTVLHHHHHH |
| 1998 | CDR-H1 of<br>CDH19<br>65251.004 | artificial | AA | NYYMS |
| 1999 | CDR-H2 of<br>CDH19<br>65251.004 | artificial | AA | IINPSGDSTYAQKFQG |
| 2000 | CDR-H3 of<br>CDH19<br>65251.004 | artificial | AA | GGIQLMLHFDY |
| 2001 | CDR-L1 of<br>CDH19<br>65251.004 | artificial | AA | SGSRSNIGSNFVN |

TABLE VI-continued

| SEQ ID NO. | DESIGNATION | SOURCE | TYPE | SEQUENCE |
|---|---|---|---|---|
| 2002 | CDR-L2 of CDH19 65251.004 | artificial | AA | TNYQRPS |
| 2003 | CDR-L3 of CDH19 65251.004 | artificial | AA | AVYDESLQGWV |
| 2004 | VH of CDH19 65251.004 | artificial | NT | CAGGTGCAGCTGGTGCAGTCTGGGGCTGAAGTTAAGAAGCCTGGGGCCTCAGTGAAGGTGTCCTGCAAGGCCTCCGGATACACCTT CACCAACTACTACATGTCCTGGGTCCGACAGGCCCCAGGACAAGGGCTTGAGTGGATGGGCATCATCAACCCCTCTGGCGGTGACT CCACCTACGCCCAGAAGTTCCAGGGCCGGTCTACCATGACCGGACACCTCCACCTGCACCCTGTATATGGAACTGTCCTCCCTG CGGAGCGAGGACACCGCCGTGTACTACTGCGCCAGGGGCATCCAGCTCTGTGGCTGCACTCTGGGGCCTGCACCCT GGTCACCCGTGTCTAGC |
| 2005 | VH of CDH19 65251.004 | artificial | AA | QVQLVQSGAEVKKPGASVKVSCKASRYTFTNYYMSWVRQAPGQGLEWMGI INPSGGDSTYAQKFQGRLTMTGDTSTSTVMELSSL RSEDTAVYYCARGGIQLWLHFDYWGQGTLVTVSS |
| 2006 | VL of CDH19 65251.004 | artificial | NT | CAGTCTGTGCTGACCCAGCCCCTTCCGCTCTGGCCTCTGTAATCAGCAGCTGCCCCGGACAGAAGTGACCATCTCCTGCTCCGGTCCCGGTTCCAACAT GGCTCCAACTTCGTGAACTGGTACCAGCAGCTCCCAGGTCTGTCCACGCAGCTGATCTACAAAGCTGTCTCCAGGCCCTCCG GCGTGCCCGACCGGTTCTCTGGCTCCAAGTCTGGCACCTCCGCCTCCCTGGCCATCTCCGGCCTGCAGTCTGAGGAGGCCGAC TACTACTGTGCCGTGTACGACAGTCCCTGCAGGGTGGGTTCGGCGGAGGCACCAAGCTGACCGTGCTGTCC |
| 2007 | VL of CDH19 65251.004 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD YYCAVYDESLQGWVFGGGTKLTVLS |
| 2008 | VH-VL of CDH19 65251.004 | artificial | NT | CAGGTGCAGCTGGTGCAGTCTGGGGCTGAAGTTAAGAAGCCTGGGGCCTCAGTGAAGGTGTCCTGCAAGGCCTCCGGATACACCTT CACCAACTACTACATGTCCTGGGTCCGACAGGCCCCAGGACAAGGGCTTGAGTGGATGGGCATCATCAACCCCTCTGGCGGTGACT CCACCTACGCCCAGAAGTTCCAGGGCCGGTCTACCATGACCGGACACCTCCACCTGCACCCTGTATATGGAACTGTCCTCCCTG CGGAGCGAGGACACCGCCGTGTACTACTGCGCCAGGGGCATCCAGCTCTGGTTCCTGCACTTCGACTACTGGGGCCAGGGCACCCT GGTCACCGTGTCTAGCGGAGGTGGAGGATCGGGCGGAGGTGGCTCTGGCGGTGGCGGATCGCAGTCTGTGCTGACCCAGCCCCCT TCGCCTCTGGCCTCTGTAACCAGCGGCCCCAGGACAGAAGGTGACCATCTCCTGCTCCGGCTCCCGGTCCAACATTGGTAAT AACAGCTGCCCGGAACTGGTACCAGCAGCTCCCAGGTCTGTGACGCCCAAGCTGCTGATCTACACCAACTACCAGCGCCCCTCCGGCGTGCCCGACCGGTTCTCTGGCTC CAAGTCTGGCACCTCCGCCTCCCTGGCCATCTCCGGCCTGCAGTCTGAGGACGAGGCCGACTACTACTGTGCCGTGTACGACGAGT CCCTGCAGGGCTGGGTCGTTCGGCGGAGCACCAAGCTGACCGTGCTGTCC |
| 2009 | VH-VL of CDH19 65251.004 | artificial | AA | QVQLVQSGAEVKKPGASVKVSCKASRYTFTNYYMSWVRQAPGQGLEWMGI INPSGGDSTYAQKFQGRLTMTGDTSTSTVMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVYDESLQGWVFGGGTKLTVLS |
| 2010 | CDH19 65251.004 × I2C | artificial | AA | QVQLVQSGAEVKKPGASVKVSCKASRYTFTNYYMSWVRQAPGQGLEWMGI INPSGGDSTYAQKFQGRLTMTGDTSTSTVMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVYDESLQGWVFGGGTKLTVLSGGGGSEVQLVES GGGLVQPGGSLKLSCAASGFTNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 2011 | CDR-H1 of CDH19 65251.005 | artificial | AA | NYYMS |

TABLE VI-continued

| SEQ ID NO. | DESIGNATION | SOURCE | TYPE | SEQUENCE |
|---|---|---|---|---|
| 2012 | CDR-H2 of CDH19 65251.005 | artificial | AA | IINPSGDSTYAQKFQG |
| 2013 | CDR-H3 of CDH19 65251.005 | artificial | AA | GGIQLWLHFDY |
| 2014 | CDR-L1 of CDH19 65251.005 | artificial | AA | SGSRSNIGSNFVN |
| 2015 | CDR-L2 of CDH19 65251.005 | artificial | AA | TNYQRPS |
| 2016 | CDR-L3 of CDH19 65251.005 | artificial | AA | AVWDDSLNGWV |
| 2017 | VH of CDH19 65251.005 | artificial | NT | CAGGTCCAGCTGGTGCAGTCTGGCGCCGAAGTGAAGAAACCTGGCGCCTCCGTGAAGGTGTCCTGCAAGGCCTCCGGGTACACCTT CACCAACTACTACATGCACTGGGTCCGACAGGCCCCAGGCCAGGGATGGGCATCATCAACCCCTCTGGCGACTCCACCTACGCCCAGAAGTTCCAGGGCCGGGTGACCATGACCCGGGACACCTCCACCTGCCGTGCTGGAGCTGAGCAGCCTGCGGAGCGAGGACACCGCCGTGTACTACTGCGCCCGTGCACTTCGACTACTGGGGCCAGGGAACCCT CGGAGCGAGGACACCGCCGTGTACTACTGCGCCCGTGGAGGAATCCAGCTGTGGCTGCACTTCGACTACTGGGGCCAGGGCACCCT GGTCACCGTGTCTAGC |
| 2018 | VH of CDH19 65251.005 | artificial | AA | QVQLVQSGAEVKKPGASVKVSCKASGYTFTNYYMHWVRQAPGQGLEWMGIINPSGDSTYAQKFQGRLTMTRDTSTSTVYMELSSL RSEDTAVYYCARGGIQLWLHFDYWGQGTLVTVSS |
| 2019 | VL of CDH19 65251.005 | artificial | NT | CAGTCTGTGCTGACCCAGCCCCCTTCGCCTCTGGCACCCTGGCCAGAAGTGACCATCTCCTGCTCCGGTTCCCGGTCCAACAT CGGCTCCAACTTCGTGAACTGGTATCAGCAGCTGCCTGGCACCGCCCGGACACCTGCAAGCTGCTGATCTACACCAACTACCAGCGCCCTCCG GCTGCCCGACCGGTTCTCTGGCTCCAAGTCTGGCACCTCGGCGCCATCTCCGGCCTGCAGTCTGAGGACGAGGCCGAC TACTACTGTGCCGTGTGGGACGACTCCCTGAACGGCTGGGTGTTCGGCGGAGGCACCAAGCTGACCGTGCTGTCC |
| 2020 | VL of CDH19 65251.005 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD YYCAVWDDSLNGWVFGGGTKLTVLS |
| 2021 | VH-VL of CDH19 65251.005 | artificial | NT | CAGGTCCAGCTGGTGCAGTCTGGCGCCGAAGTGAAGAAACCTGGCGCCTCCGTGAAGGTGTCCTGCAAGGCCTCCGGGTACACCTT CACCAACTACTACATGCACTGGGTCCGACAGGCCCCAGGCCAGGGATGGGCATCATCAACCCCTCTGGCGACTCCACCTACGCCCAGAAGTTCCAGGGCCGGGTGACCATGACCCGGGACACCTCCACCTGCCGTGCTGGAGCTGAGCAGCCTGCGGAGCGAGGACACCGCCGTGTACTACTGCGCCCGTGGAGGAATCCAGCTGTGGCTGCACTTCGACTACTGGGGCCAGGGCACCCT GGTCACCGTGTCTAGCGGAGGAGGATCTGGTGGCGGTGTTCGGCGGTGTCTGGCGGAGGCAGTCTGTGCTGACCCAGCCCCCTTCCGCCTCTGGCACCCCTGGCCAGAAGGTGACCATCTCCTGCTCCGGGTTCCCGGTCCAACATCGGCTCCAACTTCGTGAACTGGTAT CAGCAGCTGCCCGGCACCGCCCCTAAGCTGCTGATCTACACCAACTACCAGCGCCCTCCAGTCTGAGGACGAGGCCGACTACTACTGTGCCGTGTGGGACGACT CCCTGAACGGCTGGGTGTTCGGCGGAGGCACCAAGCTGACCGTGCTGTCC |
| 2022 | VH-VL of CDH19 65251.005 | artificial | AA | QVQLVQSGAEVKKPGASVKVSCKASGYTFTNYYMHWVRQAPGQGLEWMGIINPSGDSTYAQKFQGRLTMTRDTSTSTVYMELSSL RSEDTAVYYCARGGIQLWLHFDYWGQGTLVTVSSGGGGSGGGGSGGGGSQSVLTQPPSASTPGQKVTISCSGSRSNIGSNFVNWY QQLPGTAPKLLIYTNYQRPSGVPDRFSASGTPDDSLNGWVFGGGTKLTVLS |

TABLE VI-continued

| SEQ ID NO. | DESIGNATION | SOURCE | TYPE | SEQUENCE |
|---|---|---|---|---|
| 2023 | CDH19 65251.005 x I2C | artificial | AA | QVQLVQSGAEVKKPGASVKVSCKASGYTFTNYYMSWVRQAPGQGLEWMGIINPSGDSTYAQKFQGRLTMTRDTSTSTVYMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDDSLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 2024 | CDR-H1 of CDH19 65251.006 | artificial | AA | NYYMS |
| 2025 | CDR-H2 of CDH19 65251.006 | artificial | AA | IINPSGDSTYAQKFQG |
| 2026 | CDR-H3 of CDH19 65251.006 | artificial | AA | GGIQLWLHFDY |
| 2027 | CDR-L1 of CDH19 65251.006 | artificial | AA | SGSRSNIGSNFVN |
| 2028 | CDR-L2 of CDH19 65251.006 | artificial | AA | TNYQRPS |
| 2029 | CDR-L3 of CDH19 65251.006 | artificial | AA | AVWDESLNGWV |
| 2030 | VH of CDH19 65251.006 | artificial | NT | CAGGTGCAGCTGGTGCAGTCTGGGCGCCGAAGTGAAGAAACCTGGCGCCTCCGTGAAGGTGTCCTGCAAGGCCTCCGGGTACACCTT CACCAACTACTACATGTCCTGGGTCCGACAGGCCCCAGGCCAGGGCCTGGAATGGATGGGCATCATCAACCCCTCTGGCGACACT CCACCTACGCCCAGAAGTTCCAGGGCCGCGTGACCATGACCCGGGACACCTCCACCTCTGTATATGGAACTGTCTCCCTG CGGAGCGAGGACACCGCCGTGTACTACTGCGCCAGAGGCGGCATCCAGCTGTGGCTGCACTTCGACTACTGGGGCCAGGGCACCCT GGTCACCGTGTCTAGC |
| 2031 | VH of CDH19 65251.006 | artificial | AA | QVQLVQSGAEVKKPGASVKVSCKASGYTFTNYYMSWVRQAPGQGLEWMGIINPSGDSTYAQKFQGRLTMTRDTSTSTVYMELSSL RSEDTAVYYCARGGIQLWLHFDYWGQGTLVTVSS |
| 2032 | VL of CDH19 65251.006 | artificial | NT | CAGTCTGTGACCCAGCCCCCTCCGCTCTGGCCACCCCTGGCCAGAAAGTGACCATCTCCTGCTCCGGCTCCCGGTCCAACAT CGGCTCCAACTTCGTGAACTGGTATCAGCAGCTCCCGGACCAGCCCCCAAGCTGCTGATCTACACCAACTACCAGCGGCCCTCCG GCGTGCCCGACCGGTTCTCTGGCTCCAAGTCTGGCACCTCTGCCAGCCTGGCCATCTCCAGTCTGAGCTGAGGACGAGGCCGAC TACTACTGTGCCGTGTGGGACGAGAGTCTCCTGAACGGCTGGGTGTTCGGCGGAGGCACCAAGCTGACCGTGCTGTCC |
| 2033 | VL of CDH19 65251.006 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD YYCAVWDESLNGWVFGGGTKLTVLS |
| 2034 | VH-VL of CDH19 65251.006 | artificial | NT | CAGGTGCAGCTGGTGCAGTCTGGCGCCGAAGTGAAGAAACCTGGCGCCTCCGTGAAGGTGTCCTGCAAGGCCTCCGGGTACACCTT CACCAACTACTACATGTCCTGGGTCCGACAGGCCCCAGGCCAGGGCCTGGAATGGATGGGCATCATCAACCCCTCTGGCGACT CCACCTACGCCCAGAAGTTCCAGGGCCGGCTGACCATGACCCGGGACACCTCCACCTCTGTATATGGAACTGTCTCCCTG |

TABLE VI-continued

| SEQ ID NO. | DESIGNATION | SOURCE | TYPE | SEQUENCE |
|---|---|---|---|---|
| | | | | CGGAGCCAGGACACCCGCGTGTACTACTGCGCCAGAGGCGCATCCAGCTGTGGCTGCACTTGACTTCGACTACTGGGGCCAGGGCACCCT |
| | | | | GGTCACCGTGTCTAGCGGAGGCGGAGGATCTGGTGGCGGCGGAAGTGACATCTCCTGCTCCGGTTCTCGCGAGGTCGTGCAACATCGGT |
| | | | | CCGCTTCTGGCCACCCCTGGCCAGGCCAGAAAGTGACCATCTCCTGCTCAAGTCACCATCGGTTCCAACATCGGTTCCAACTTCGTGAACTGGTAT |
| | | | | CAGCAGCTGCCCGGACCAGCCCCTCCCTGCTGCCCGTGTGCTATTCCGGCCATCTCCGGCTCTGATCTACACCAACTACCAGCGCCCCTCTGGC |
| | | | | CAAGTCTGGCACTCCGGGAGTCCCCTGACCGCTCCGGCCAACTGACCATCTCCGGCCACTCCCGGCCTGCCTCTCTGGCTC |
| | | | | CCCTGAACGGCTGGGTTCGCGGAGGCCACCAAGCTGACCGTGTCC |
| 2035 | VH-VL of CDH19 65251.006 | artificial | AA | QVQLVQSGAEVKKPGASVKVSCKASGYTFTNYYMSWVRQAPGQGLEWMGIINPSGGDSTYAQKFQGRLTMTRDTSTSTVYMELSSL RSEDTAVYYCARGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLNGWVFGGGTKLTVLS |
| 2036 | CDH19 65251.006 x I2C | artificial | AA | QVQLVQSGAEVKKPGASVKVSCKASGYTFTNYYMSWVRQAPGQGLEWMGIINPSGGDSTYAQKFQGRLTMTRDTSTSTVYMELSSL RSEDTAVYYCARGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLNGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 2037 | CDR-H1 of CDH19 65251.007 | artificial | AA | NYYMS |
| 2038 | CDR-H2 of CDH19 65251.007 | artificial | AA | IINPSGGDSTYAQKFQG |
| 2039 | CDR-H3 of CDH19 65251.007 | artificial | AA | GGIQLWLHFDY |
| 2040 | CDR-L1 of CDH19 65251.007 | artificial | AA | SGSRSNIGSNFVN |
| 2041 | CDR-L2 of CDH19 65251.007 | artificial | AA | TNYQRPS |
| 2042 | CDR-L3 of CDH19 65251.007 | artificial | AA | AVWDESLQGWV |
| 2043 | VH of CDH19 65251.007 | artificial | NT | CAGGTGCAGCTGGTGCAGTCTGGGCGCCGAAGTCGCCTCCGTGAAGGTGTCCTGCAAGGCCTCCGGGTACACCTT CACCAACTACTACATGTCCTGGGTCCGACAGGCCCCAGGCCAGGGCCTGACGTGGCATCATCAACCCCTCTGGCCGGCGACT ACCTACGCCCAGAAGTTCCAGGGCCGGCTGACCATGACCCGCGACACCCTCCACCTCGACTTGCTCACCTGTGCTCCCTG CGGAGGCGAGGACACCGCCGTGTACTACTGCGCCAGAGGCGGCATCCAGCTGTGGCTGCACTTCGACTACTGGGGCCAGGGCACCCT GGTCACCGTGTCTAGC |
| 2044 | VH of CDH19 65251.007 | artificial | AA | QVQLVQSGAEVKKPGASVKVSCKASGYTFTNYYMSWVRQAPGQGLEWMGIINPSGGDSTYAQKFQGRLTMTRDTSTSTVYMELSSL RSEDTAVYYCARGIQLWLHFDYWGQGTLVTVSS |

TABLE VI-continued

| SEQ ID NO. | DESIGNATION | SOURCE | TYPE | SEQUENCE |
|---|---|---|---|---|
| 2045 | VL of CDH19 65251.007 | artificial | NT | CAGTCTGTGCTGACCCAGCCCCCTTCGCCTCTGGCACCCCTGGCCAGAAAGTGACCATCTCTGCTCCGGCTCCCGATCCAACAT CGGCTCCAACTTGTGAACTGGTATCAGCAGCTGCCCGGAACAGCCCCCAAGCTGCTGATCTACAACTACCAGCGGCCCTCCG GCGTGCCCGACCGGTTCTCTGGCTCAAGTCTCTGGCACCTCCGCCTCCCTGGCCATCTCCGGCCTCAGTCTGAGGACGAGGCCGAC TACTACTGTGCCGTGTGGGACGAGTCCCTGCAGGGTGGTTCGGCAGGCCACCAAGCTGACCGTGCTGTCC |
| 2046 | VL of CDH19 65251.007 | artificial | AA | QSVLTQPPSASGTPGQKVTISCSGSRSNIGSNFVNWYQQLPGTAPKLLIYTNYQRPSGVPDRFSGSKSGTSASLAISGLQSEDEAD YYCAVWDESLQGWVFGGGTKLTVLS |
| 2047 | VH-VL of CDH19 65251.007 | artificial | NT | CAGGTGCAGCTGGTGCAGTCTGGCGCCGAAGTGAAGAAACCTGGCGCTCCTCGAAGGTGTCCTGCAAGGCCTCCGGGTACACCTT CACCAACTACTACATGTCCTGGGTCCGACAGGCCCAGGCCGCTGGAATGGATGGGCATCATCAACCCTTCTGGCGGCGACT CCACTACGCCCAGAAGTTCCAGGGCCGGTGACCATGACCCGCGACACCTCCACCGTGTATATGGAACTGTCTCCCTG CGGAGCGAGGACGACCGCCGTGTACTACTGCGCCAGAGGCATCCAGTCTGCACTTCGACTATTGGGGCCAGGGCACCCT GGTCACCGTGTCTAGCGGAGGCGGAGGATCTGGTGGCGGAGGCTCCGGAGGCTCCAGTCTGTGCTGACCCAGCCCCTT CCGCCTCTGGCACCCCTGGCCAGAAAGTGACCATCTCCTGCTCCGGCTCCAGATCGGAATCGGCTCCAACTTCGTGAACTGGTAT CAGCAGCTGCCCGGAACGCCCCCAAGCTGCTGATCTACACCAACTACCAGCGCCCTCCGGCGTGCCCGACCGGTTCTCTGGCTC CAAGTCTGGCACCTCCGCCTCCCTGCCAGTCTGAGGACGAGGCCGACTACTACTGTGCCGTGTGGGACGAGT CCCTGCAGGGCTGGGTGTTCGGCGGAGGCACCAAGCTGACCGTGCTGTCC |
| 2048 | VH-VL of CDH19 65251.007 | artificial | AA | QVQLVQSGAEVKKPGASVKVSCKASGYTFTNYYMSWVRQAPGQGLEWMGIINPSGDSTYAQKFQGRLTMTRDTSTSTVMELSSL RSEDTAVYYCARGGIQLWLHEDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLQGWVFGGGTKLTVLS |
| 2049 | CDH19 65251.007 x I2C | artificial | AA | QVQLVQSGAEVKKPGASVKVSCKASGYTFTNYYMSWVRQAPGQGLEWMGIINPSGDSTYAQKFQGRLTMTRDTSTSTVMELSSL RSEDTAVYYCARGGIQLWLHFDYWGQGTLVTVSSGGGGSGGGGSGGGGSQSVLTQPPSASGTPGQKVTISCSGSRSNIGSNFVNWY QQLPGTAPKLLIYTNYQRPSGVPDRFSGSKSGTSASLAISGLQSEDEADYYCAVWDESLQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVTLTCGSSTGAVTSGNYPNWVQ QKPGQAPRGLIGGTKFLAPGTPARFSGSLLGGKAALTLSGVQPEDEAEYYCVLWYSNRWVFGGGKLTVLHHHHHH |
| 2050 | CDR-H1 of CDH19 65251.008 | artificial | AA | NYYMS |
| 2051 | CDR-H2 of CDH19 65251.008 | artificial | AA | IINPSGDSTYAQKFQG |
| 2052 | CDR-H3 of CDH19 65251.008 | artificial | AA | GGIQLWLHFDY |
| 2053 | CDR-L1 of CDH19 65251.008 | artificial | AA | SGSRSNIGSNFVN |
| 2054 | CDR-L2 of CDH19 65251.008 | artificial | AA | TNYQRPS |

TABLE VI-continued

| SEQ ID NO. | DESIGNATION | SOURCE | TYPE | SEQUENCE |
|---|---|---|---|---|
| 2055 | CDR-L3 of CDH19 65251.008 | artificial | AA | AVYDESLQGWV |
| 2056 | VH of CDH19 65251.008 | artificial | NT | CAGGTGCAGCTGGTGCAGTCTGGCGCCGAAGTGAAGAAACCTGGCGCCTCCGTGAAGGTGTCCTGCAAGGCCTCCGGGTACACCTT CACCAACTACTACATGTCCTGGGTCCGACAGGCCCCAGGCCAGGGCCTGAATGATGGCATATCAACCCTCTGGCGACT CCACCTACGCCCAGAAGTTCCAGGGCCGGTGACCATGACCCGCGACACCTCCACTGTGCCACCGTGTATATGGAACTGTCCTCCCTG CGGAGCGAGGACACCGCCGTGTACTACTGCGCCGTGTACGACGAGTCCCTGCAGGGCTGGGTCCAGGGCACCCTG GTCACCGTGTCTAGC |
| 2057 | VH of CDH19 65251.008 | artificial | AA | QVQLVQSGAEVKKPGASVKVSCKASGYTFTNYYMSWVRQAPGQGLEWMGIINPSGGDSTYAQKFQGRLITMTRDTSTSTVYMELSSL RSEDTAVYYCARGIQLWLHFDYWGQGTLVTVSS |
| 2058 | VL of CDH19 65251.008 | artificial | NT | CAGTCTGTGCTGACCCAGCCCCCTTCCGCTTCCGGCACCCCTGGCCAGAAGTGACCATCTCCTGCTCCGGCTCCCGGTCCAACAT CGGCTCCAACTTCGTGAACTGGTATCAGCAGCTGCCCGGCACCGCCCCAAGCTGCTGATCTACTACAACCTACCAGGCCCTCCG GCGTGCCCGACCGGTTCTCTGGCTCCAAGTCTGGCACCTCCGCCATCTCCGGCCTGCAGAGTCGGAGGACGAGGCCGAC TACTACTGCCAGTCCTGTAGACAGAGTCCCTGCAGGGTGTTCGGCGGAGGCACCAAGCTGACCGTGCTGTC |
| 2059 | VL of CDH19 65251.008 | artificial | AA | QSVLTQPPSASGTPGQKVTISCSGSRSNIGSNFVNWYQQLPGTAPKLLIYNYQRPSGVPDRFSGSKSGTSASLAISGLQSEDEAD YYCAVYDESLQGWVFGGGTKLTVLS |
| 2060 | VH-VL of CDH19 65251.008 | artificial | NT | CAGGTGCAGCTGGTGCAGTCTGGCGCCGAAGTGAAGAAACCTGGCGCCTCCGTGAAGGTGTCCTGCAAGGCCTCCGGGTACACCTT CACCAACTACTACATGTCCTGGGTCCGACAGGCCCCAGGCCAGGGCCTGAATGATGGCATATCAACCCTCTGGCGACT CCACCTACGCCCAGAAGTTCCAGGGCCGGTGACCATGACCCGCGACACCTCCACTGTGCCACCGTGTATATGGAACTGTCCTCCCTG CGGAGCGAGGACACCGCCGTGTACTACTGCGCCGTGTACGACGAGTCCCTGCAGGGCTGGGTCCAGGGCACCCT GGTCACCGTGTCTAGCGGAGGCGGCGGCAGCGGAGGGGCCAGCAGCGGAGGCGGCGGATCTCAGTCTGTGCTGACCCAGCCC CCTTCCGCTTCCGGCACCCCTGGCCAGAAGGTGACCATCTCCTGCTCCGGCTCCCGGTCCAACATCGGCTCCAACTTCGTGAACTGGTAT CAGCAGCTGCCCGGCACCGCCCCCAAGCTGCTGATCTACAACTACCAGCGGCCCTCCGGCGTGCCCGACCGGTTCTCTGGCTC CAAGTCTGGCACCTCCGCCATCTCCGGCCTGCAGTCTGAGGACGAGGCCGACTACTACTGCGCCGTGTACGACGAGT CCCTGCAGGGCTGGGTTCGGCGGAGGCACCAAGCTGACCGTGCTGTCC |
| 2061 | VH-VL of CDH19 65251.008 | artificial | AA | QVQLVQSGAEVKKPGASVKVSCKASGYTFTNYYMSWVRQAPGQGLEWMGIINPSGGDSTYAQKFQGRLITMTRDTSTSTVYMELSSL RSEDTAVYYCARGIQLWLHFDYWGQGTLVTVSSGGGGSGGGGSGGGGSQSVLTQPPSASGTPGQKVTISCSGSRSNIGSNFVNWY QQLPGTAPKLLIYNYQRPSGVPDRFSGSKSGTSASLAISGLQSEDEADYYCAVYDESLQGWVFGGGTKLTVLS |
| 2062 | CDH19 65251.008 x I2C | artificial | AA | QVQLVQSGAEVKKPGASVKVSCKASGYTFTNYYMSWVRQAPGQGLEWMGIINPSGGDSTYAQKFQGRLITMTRDTSTSTVYMELSSL RSEDTAVYYCARGIQLWLHFDYWGQGTLVTVSSGGGGSGGGGSGGGGSQSVLTQPPSASGTPGQKVTISCSGSRSNIGSNFVNWY QQLPGTAPKLLIYNYQRPSGVPDRFSGSKSGTSASLAISLQSEDEADYYCAVYDESLQGWVFGGGTKLTVLSGGGGSEVQLVES GGGLVQPGGSLKLSCAASGFTFNKYAMNWVRQAPGKGLEWVARIRSKYNNYATYYADSVKDRFTISRDDSKNTAYLQMNNLKTEDT AVYYCVRHGNFGNSYISYWAYWGQGTLVTVSSGGGGSGGGGSGGGGSQTVVTQEPSLTVSPGGTVLTCGSSTGAVTSGNYPNWVQ QKPGQAPRGLIGGTKFLAPGTPARFSGSLLGGKAALTLSGVQPEDEAEYYCVLWYSNRWVFGGGTKLTVLHHHHHH |
| 2063 | CDR-H1 of CDH19 65252.005 | artificial | AA | SYDMD |
| 2064 | CDR-H2 of CDH19 65252.005 | artificial | AA | VIWYDGSNKYYADSVRG |

TABLE VI-continued

| SEQ ID NO. | DESIGNATION | SOURCE | TYPE | SEQUENCE |
|---|---|---|---|---|
| 2065 | CDR-H3 of CDH19 65252.005 | artificial | AA | ETGEGWYFDL |
| 2066 | CDR-L1 of CDH19 65252.005 | artificial | AA | RASQSVSSSYLA |
| 2067 | CDR-L2 of CDH19 65252.005 | artificial | AA | GASSRAT |
| 2068 | CDR-L3 of CDH19 65252.005 | artificial | AA | QQYGSSWT |
| 2069 | VH of CDH19 65252.005 | artificial | NT | CAGGTGCAGCTGGTGGAATCCGGCGGAGGCGTGGTGCAGCCTGGCGGTCCTGGCAGCTTGTCTGTGCCGCCTCCGGCTTCAGCTT CTCCTCTACGACATGGGATTGCGCGGGACAGATTCCCGGGACAACTCCAAGAACACCCTGTTTCTGCAGATGAACTCCCTG CGGGTGGAAGATACCGCCGTGTACTACTGCGCCGTGTACTACTGCGCCAGAGAGACCAGGCGAGGGCTGGTACTTCGACCTGTGGGGCCAGAGAGGCACCCTGGT CACCGTGTCTAGC |
| 2070 | VH of CDH19 65252.005 | artificial | AA | QVQLVESGGGVVQPGGSLRLSCAASGFSFSSYDMDWVRQTPGKGLEWVAVIWYDGSNKYYADSVRGRFTISRDNSKNTLFLQMNSL RVEDTAVYYCARETGEGWYFDLWGRGTLVTVSS |
| 2071 | VL of CDH19 65252.005 | artificial | NT | GAGATCGTGCTGACCCAGTCCCCTGGCACCCTGTCCCTGAGCCCTGGAGAGCCACCCTGTCCTGCCGGGCAGCTGTCTCCTGAGACTGTCTTGTGCCGCCTCCAGTCCGT GTCCTCCTCCTACCTGGCCTGGTATCAGCAGAAGCCCGGCCAGGCCCCTCGGCTGCTGATCTACGGCGCCTCTTCCAGAGCCACCG GCATCCCTGACCGGTTCTCCGGCTCTGGCTCTGGCACCGACTTCACCCTGACCATCAGCTCGCTGAACCCGAGGACTTCGCTGTG TACTATTGCCAGCAGTACGGCTCCTCCTGGACCTTCGGCCAGGGCACCAAGGTGGAAATCAAGTCC |
| 2072 | VL of CDH19 65252.005 | artificial | AA | EIVLTQSPGTLSLSPGERATLSCRASQSVSSSYLAWYQQKPGQAPRLLIYGASSRATGIPDRFSGSGSGTDFTLTISSLEPEDFAV YYCQQYGSSWTFGQGTKVEIKS |
| 2073 | VH-VL of CDH19 65252.005 | artificial | NT | CAGGTGCAGCTGGTGGAATCCGGCGGAGGCGTGGTGCAGCCTGGCGGTCCTGGCAGCTTGTCTGTGCCGCCTCCGGCTTCAGCTT CTCCTCTACGACATGGATTGCGCGGGACAGATTCCCGGGACAACTCCAAGAACACCCTGTTTCTGCAGATGAACTCCCTG CGGGTGGAAGATACCGCCGTGTACTACTGCGCCAGAGAGACCGAGGGCTGGTACTTCGACCTGTGGGGCCAGAGAGGCACCCTGGT CACCGTGTCTAGCGGAGGCGGAGGATCTGGTGGCGGAGGCTCCGGAGGCGGAGGATCCGAGATCGTGCTGACCCAGTCCCCTGGCA CCCTGTCTAGCCCGGGAGAGCCGCCCTGTCCGTGCCGCCTCCCAGAGCGTGTCCTCCTCCTACCTGGCCTGGTATCAG CAGAAGCCCGGCCAGGCCCCTCGGCTGCTGATCTACGGCGCCTCTTCCAGAGCCACCGGCATCCCTGACCGGTTCTCCGGCTCTGG CTCCGGCACCGACTTCACCCTGACCATCAGCTCGCTGGAACCCGAGGACTTCGCTGTGTACTATTGCCAGCAGTACGGCTCCTCCT GGACCTTCGGCCAGGGCACCAAGGTGGAAATCAAGTCC |
| 2074 | VH-VL of CDH19 65252.005 | artificial | AA | QVQLVESGGGVVQPGGSLRLSCAASGFSFSSYDMDWVRQTPGKGLEWVAVIWYDGSNKYYADSVRGRFTISRDNSKNTLFLQMNSL RVEDTAVYYCARETGEGWYFDLWGRGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKS |
| 2075 | CDH19 65252.005 x I2C | artificial | AA | QVQLVESGGGVVQPGGSLRLSCAASGFSFSSYDMDWVRQTPGKGLEWVAVIWYDGSNKYYADSVRGRFTISRDNSKNTLFLQMNSL RVEDTAVYYCARETGEGWYFDLWGRGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY |

TABLE VI-continued

| SEQ ID NO. | DESIGNATION | SOURCE | TYPE | SEQUENCE |
|---|---|---|---|---|
| 2076 | CDR-H1 of CDH19 65252.006 | artificial | AA | CVRHGNFGNSYISYWAYWGQGTLVTVSSGGGGSGGGGSGGGGSQTVVTQEPSLTVSPGGTVLTCSSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 2077 | CDR-H1 of CDH19 65252.006 | artificial | AA | SYDMD |
| 2077 | CDR-H2 of CDH19 65252.006 | artificial | AA | VIWYDGSNKYYADSVRG |
| 2078 | CDR-H3 of CDH19 65252.006 | artificial | AA | ETGEGWYFDL |
| 2079 | CDR-L1 of CDH19 65252.006 | artificial | AA | RASQSVSSSYLA |
| 2080 | CDR-L2 of CDH19 65252.006 | artificial | AA | GASSRAT |
| 2081 | CDR-L3 of CDH19 65252.006 | artificial | AA | QQYGSSWT |
| 2082 | VH of CDH19 65252.006 | artificial | NT | CAGGTGCAGCTGGTGGAATCCGGCGGAGGCGTGGTGCAGCCTGGCGGGTCCGGCGGTCTGCGTCTTGTGCCCGCTTCCGGCTTCAGCTT CTCCTCCTACGACATGGATTGGGTCCGACAGGCCCCGGCAAGGGCCTGGAATGGGTGGCCGTGATTTGGTACGACGGCTCCAACA AGTACTACGCCGACTCCGTGCGCGGGCAGATTCACCATCTCCAGAGACAACTCCAAGAACACCCTGTTTCTGCAGATGAACTCCCTG CGGGTGGAAGATACCGCCGTCTACTACTGCGCCAGAGAGACCGAGGGCTGGTACTTCGACCTGTGGGGCAGAGGCACCCTGGT CACCGTGTCTAGC |
| 2083 | VH of CDH19 65252.006 | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGRGTLVTVSS |
| 2084 | VL of CDH19 65252.006 | artificial | NT | GAGATCGTGCTGACCCAGTCCCCTGGCACCCTGTCCCTGAGCCCAGGCGAGAGAGCCACCCTGTCCTGCAGAGCCTCCCAGTCCGT GTCCTCCTCCTACCTGGCCTGGTATCAGCAGAAGCCCGGCCAGGCCCCTCGGCTGCTGATCTATGGAGCCTCTTCCAGAGCCACCG GCATCCCCTGACCGGTTCTCCGGCAGTGGCTCTGGCACCGACTTCACCCTGACCATCAGCTCGCTGGAACCCGAGGACTTCGCTGTG TACTATTGCCAGCAGTACGGCTCTCCTCCTGGACCTTCGGCCAGGGCACCAAGGTGGAAATCAAGTCC |
| 2085 | VL of CDH19 65252.006 | artificial | AA | EIVLTQSPGTLSLSPGERATLSCRASQSVSSSYLAWYQQKPGQAPRLLIYGASSRATGIPDRFSGSGSGTDFTLTISSLEPEDFAV YYCQQYGSSWTFGQGTKVEIKS |
| 2086 | VH-VL of CDH19 65252.006 | artificial | NT | CAGGTGCAGCTGGTGGAATCCGGCGGAGGCGTGGTGCAGCCTGGCGGGTCCGGCGGTCTGCGTCTTGTGCCCGCTTCCGGCTTCAGCTT CTCCTCCTACGACATGGATTGGGTCCGACAGGCCCCGGCAAGGGCCTGGAATGGGTGGCCGTGATTTGGTACGACGGCTCCAACA AGTACTACGCCGACTCCGTGCGCGGGCAGATTCACCATCTCCAGAGACAACTCCAAGAACACCCTGTTTCTGCAGATGAACTCCCTG CGGGTGGAAGATACCGCCGTCTACTACTGCGCCAGAGAGACCGAGGGCTGGTACTTCGACCTGTGGGGCAGAGGCACCCTGGT CACCGTGTCTAGCGGCGGAGGCGGAAGTGGTGGCGGAGGCTCTGGCGGAGGCGGATCCGGTGTCCTGAGAGCCCTGGCGAGATCGTG CTGACCCAGTCCCCTGGCACCCTGTCCCTGAGCCCAGGCGAGAGAGCCACCCTGTCCTGCAGAGCCTCCCAGTCCGTGTCCAGCA GCTACCTGGCCTGGTATCAGCAGAAGCCCGGCCAGGCCCCTCGGCTGCTGATCTACGGCGCCTCTTCCAGAGCCACCGGCATCCCCG ACAGAAGCCGGCCAGGGCCGGTCCCCTGTCTCCGCCTGTCCTCCTGGAACCCGAGGACTTCGCTGTG |

| SEQ ID NO. | DESIGNATION | SOURCE | TYPE | SEQUENCE |
|---|---|---|---|---|
| 2087 | VH-VL of CDH19 65252.006 | artificial | AA | CTCCGGCACCGACTTCACCCTGACCATCAGCTCGCTGGAACCCGAGGACTTCGCTGTGTACTATTGCCAGCAGTACGGCTCCTCCTGGACCTTCGGCCAGGGCACCAAGGTGGAAATCAAGTCC<br>QVQLVESGGGVVQPGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGRGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKS |
| 2088 | CDH19 65252.006 x I2C | artificial | AA | QVQLVESGGGVVQPGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGRGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWARIRSKYNNYATYYADSVKDRFTISRDDSKNTAYLQMNNLKTEDTAVYY CVRHGNFGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARPSGSLLGGKAALTLSGVQPEDEAEYYCVLWYSNRWVFGGGTKLTVLHHHHHH |
| 2089 | CDR-H1 of CDH19 65252.007 | artificial | AA | SYDMD |
| 2090 | CDR-H2 of CDH19 65252.007 | artificial | AA | VIWYDGSNKYYADSVRG |
| 2091 | CDR-H3 of CDH19 65252.007 | artificial | AA | ETGEGWYFDL |
| 2092 | CDR-L1 of CDH19 65252.007 | artificial | AA | RASQSVSSSYLA |
| 2093 | CDR-L2 of CDH19 65252.007 | artificial | AA | GASSRAT |
| 2094 | CDR-L3 of CDH19 65252.007 | artificial | AA | QQYGSSWT |
| 2095 | VH of CDH19 65252.007 | artificial | NT | CAGGTGCAGCTGGTGGAATCCGGCGGAGGCGTGGTCCAGCCTGGCGGCTCCCTGCGCCTCCGGCTTCAGCTT CTCCTCCTACGACATGGACTGGGTCCGACAGGCCCCGGCAAGGGCCTGGAATGGGTGGCCGTGATTTGGTACGACGGCTCCAACA AGTACTACGCCGACTCCGTGCGGGGCAGATTCACCATCTCCCGGGACAATTCCAAGAACACCCTGTTTCTGCAGATGAACTCCCTG CGGGTGGAAGATACCGCCGTGTACTACTGCGCCAGAGAGACGGGCGAGGGCTGGTACTTCGACCTGTGGGGCCAAGGCACCCTGGT CACCGTGTCTAGC |
| 2096 | VH of CDH19 65252.007 | artificial | AA | QVQLVESGGGVVQPGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSS |
| 2097 | VL of CDH19 65252.007 | artificial | NT | GAGATCGTGCTGACCCAGTCCCCTGCCACCCTGTCCCTGAGCCCTGGCGAGAGAGCCACCCTGTCCTGCAGAGCCTCCCAGTCCGT GTCCTCCTCCTACCTGGCCTGGTATCAGCAGAAGCCCGGCCAGGCCCCTCGGCTGCTGATCTACGGCGCCTCTTCCAGAGCCACCG GCATCCCTGACCGGTTCTCCGGCTCCGGCTCCGGCACCGACTTCACCCTGACCATCAGCTCCCTGGAACCCGAGGACTTCGCTGTG TACTATTGCCAGCAGTACGGCTCCTCCTGGACCTTCGGCCAGGGCACCAAGGTGGAAATCAAGTCC |

TABLE VI-continued

| SEQ ID NO. | DESIGNATION | SOURCE | TYPE | SEQUENCE |
|---|---|---|---|---|
| 2098 | VL of CDH19 65252.007 | artificial | AA | EIVLTQSPGTLSLSPGERATLSCRASQSVSSSYLAWYQQKPGQAPRLLIYGASSRATGIPDRFSGSGSGTDFTLTISSLEPEDFAV YYCQQYGSSWTFGQGTKVEIKS |
| 2099 | VH-VL of CDH19 65252.007 | artificial | NT | CAGGTGCAGCTGGTGGTGGAATCCGGCGGCGGAGGCCTGGTCCAGCCTGGCGGGTCCCTGCGCCTCTGTGCCGCCTCAGCTT CTCCTCCTACGACATGGACTGGGTCCGACAGGCCCCTGGAAAGGGCCTGGAATGGGTGGCCGTGATTTGGTACGACGGCTCCAACA AGTACTACGCCGACTCCGTGCAGGGCAGATTCACCATCTCCCGGGACAACTCCAAGAACACCCTGTTTCTGCAGATGAACTCCCTG CGGGTGGAAGATACCGCCGTGTACTACTGCGCCAGAGAGACAGGCGAGGGCAATTGGTACTTCGACCTGTGGGGCCAAGGCACCCTG GTCACCGTCTAGCGGAGGCGGAGGATCGGGTGGCGGCGGTAGTCCGAGATCGGTGCTGACCCAGTCCCCTGGCA CCCTGTCCCTGAGCCCTGGCGAGAGAGCCACCCTGTCCTGCAGAGCCGCTCTTCCAGAGCGTCGTCCAGCTCCTACCTGGCCTATCAG CAGAAGCCCGGCCAGGCCCCTAGGCTGCTGATCTACGGCGCTGCTTCCAGAGCCACCGGCATCCCTGACCGGTTCTCCGGCTCTGG CTCCGGCACCGACTTCACCCTGACCATCAGCTCGCTGGAACCCGAGGACTTCGCTGTATTGCCAGCAGTACGGTTCTCCT GGACCTTCGGCCAGGGCACCAAGGTGGAAATCAAGTCC |
| 2100 | VH-VL of CDH19 65252.007 | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSSGGGGSGGGGGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKS |
| 2101 | CDH19 65252.007 x I2C | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSSGGGGSGGGGGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSVISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 2102 | CDR-H1 of CDH19 65252.008 | artificial | AA | SYDMD |
| 2103 | CDR-H2 of CDH19 65252.008 | artificial | AA | VIWYEGSNKYYAESVRG |
| 2104 | CDR-H3 of CDH19 65252.008 | artificial | AA | ETGEGWYFDL |
| 2105 | CDR-L1 of CDH19 65252.008 | artificial | AA | RASQSVSSSYLA |
| 2106 | CDR-L2 of CDH19 65252.008 | artificial | AA | GASSRAT |
| 2107 | CDR-L3 of CDH19 65252.008 | artificial | AA | QQYGSSWT |
| 2108 | VH of CDH19 65252.008 | artificial | NT | CAGGTGCAGCTGGTGGAATCCGGCGGCGGAGGCCTGGTCCAGCCTGGCGGGTCCCTGCGCCTCTGTGCCGCCTCAGCTT CTCCTCCTACGACATGGACTGGGTCCGACAGGCCCCCGGCAAGGGCCTGGAATGGGTGGCCGTGATTTGGTACGAGGGCTCCAACA |

TABLE VI-continued

| SEQ ID NO. | DESIGNATION | SOURCE | TYPE | SEQUENCE |
|---|---|---|---|---|
| 2109 | VH of CDH19 65252.008 | artificial | AA | AGTACTACGCCCAGTCCGTGCGGGCAGATTCACCATCTCCGGACAACACCCTGTTTCTGCAGATGAACTCCCTG CGGGTGGAAGATACCGCCGTGTACTACTGCGCCAGAGAGACCGGAGGGCTGGTACTTCGACCTGTGGGGCCAAGGCCACCCTGGT CACCGTGTCTAGC QVQLVESGGGVVQPGGSLRLSCAASGFSFSSYDMDWVRQAPGKGLEWVAVIWYEGSNKYYAESVRGRFTISRDNSKNTLFLQMNSL RVEDTAVYYCARETGEGWYFDLWGQGTLVTVSS |
| 2110 | VL of CDH19 65252.008 | artificial | NT | GAGATCGTGCTGACCCAGTCCCCTGGAACCCTGTCCCTGTCTCCTGGAGAGAGAGCCACCCTGTCCTGCAGAGCCTCCCAGTCCGT GTCCTCCTCCTACCTGGCCTGGTATCAGCAGAAGCCCGGCCAGGCCCCCCGGCTGCTGATCTACGGCGCCTCTTCCAGAGCCACCG GCATCCCTGACCGGTTCTCCGGCTCTGGCTCCGGCACCGACTTCACCCTGACCATCAGCTCTCTGGAACCCGAGGACTTCGCTGTG TACTATTGCCAGCAGTACGGCTCCTCCTGGACCTTCGGCCAGGGCACCAAGGTGGAAATCAAGTCC |
| 2111 | VL of CDH19 65252.008 | artificial | AA | EIVLTQSPGTLSLSPGERATLSCRASQSVSSSYLAWYQQKPGQAPRLLIYGASSRATGIPDRFSGSGSGTDFTLTISSLEPEDFAV YYCQQYGSSWTFGQGTKVEIKS |
| 2112 | VH-VL of CDH19 65252.008 | artificial | NT | CAGGTCCAGTCTGGAATCCGGCGAGGCGTGGTGCAGCCTGGCGTCGCAGCGGTCCTCTGTGCCGCCTCCGGCTTCAGCTT CTCCTCCTACGACATGGACTGGGTCCGACAGGCCCCCGGCCAAGGGCCTGGAATGGGTGGCCGTGATTGGTACGAGGGCTCCAACA AGTACTACGCCGAGTCCGTGAGATACGGCCCGGACACCTCCCGGACAACACCCTGTTTCTGCAGATGAACTCCCTG CGGGTGGAAGATACCGCCGTGTACTACTGCGCCAGAGAGACCGGAGAGGGCTGGTACTTCGACCTGTGGGGCCAAGGCCACCCTGGT CACCGTGTCTAGCGGTGGAGGCGGTTCAGGCGGAGGTGGCTCTGGCGGTGGCGGATCGGAGATCGTGCTGACCCAGTCCCCTGGCA CCCTGTCCCTGAGCCCTGGCGAGAGACCCACCCTGTCCTGCAGAGCCTCCCAGTCCGTGTCCTCCTCCTACCTGGCCTGGTATCAG CAGAAGCCCGGCCAGGCCCCTCACCCTGCTGATCTACGGCGCCTCTTCCAGAGCCACCGGCATCCCGACCGGTTCTCCGGCTCTGG CTCCGGCACCGACTTCACCCTGACCATCAGCTCGCTGTGCTATATTGCCAGCAGTACGGCTCCCT GGACCTTCGGCCAGGGCACCAAGGTGGAAATCAAGTCC |
| 2113 | VH-VL of CDH19 65252.008 | artificial | AA | QVQLVESGGGVVQPGGSLRLSCAASGFSFSSYDMDWVRQAPGKGLEWVAVIWYEGSNKYYAESVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKS |
| 2114 | CDH19 65252.008 x I2C | artificial | AA | QVQLVESGGGVVQPGGSLRLSCAASGFSFSSYDMDWVRQAPGKGLEWVAVIWYEGSNKYYAESVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QKPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 2115 | CDR-H1 of CDH19 65252.009 | artificial | AA | SYDMD |
| 2116 | CDR-H2 of CDH19 65252.009 | artificial | AA | VIWYDGSNKYYADSVRG |
| 2117 | CDR-H3 of CDH19 65252.009 | artificial | AA | ETGEGWYFDL |
| 2118 | CDR-L1 of CDH19 65252.009 | artificial | AA | RASQSVSSSYLA |

TABLE VI-continued

| SEQ ID NO. | DESIGNATION | SOURCE | TYPE | SEQUENCE |
|---|---|---|---|---|
| 2119 | CDR-L2 of CDH19 65252.009 | artificial | AA | GASSRAT |
| 2120 | CDR-L3 of CDH19 65252.009 | artificial | AA | QQYGSSWT |
| 2121 | VH of CDH19 65252.009 | artificial | NT | CAGGTGCAGCTGGTGGAATCTGGCGGAGGCTGGTCAGCCTGGCCTCCGAGACTCTGTGCCGCCTCTCAGCTT CTCCTCCTACGACATGGACTGGGTCCGACAGACCCCCGGCAAGGGCCTGGAATGGGTGGCCGTGATTTGGTACGACGGCTCCAACA AGTACTACGCCGACTCCGTGCGGGGCAGATTCACCATCTCCCGGACAACTCCAAGAACACCCTGTTTCTGCAGATGAACTCCCTG CGGGTGGAAGATACCGCCGTGTACTACTGCGCCAGAGAGACGAGGCTACCTGCCACCTGTGGGGCCAGGGCACCCTGGT CACCGTGTCTAGC |
| 2122 | VH of CDH19 65252.009 | artificial | AA | QVQLVESGGGVVQPGSLRLSCAASGFSFSSYDMDWVRQTPGKGLEWVAVIWYDGSNKYYADSVRGRFTISRDNSKNTLFLQMNSL RVEDTAVYYCARETGEWYFDLWGRGTLVTVSS |
| 2123 | VL of CDH19 65252.009 | artificial | NT | GAGATCGTGCTGACCCAGTCCCCTGGCACCCTGTCCCTGAGCCCTGGCGAGAGAGCCACCCTGTCCTGCAGAGCCCTGAGCGCCACCG GCATCCCTGACCGGTTCTCCGGCTCCGGCTCCGGCACCGACTTCACCCTGACCATCAGCTCGCTGGAACCCGAGGACTTCGCTGTG GTCATCCCTGACCGGTTCTCCGGCTCCGGCTCCGGCACCGACTTCACCCTGACCATCAGCTCCTGGAACCCGAGGACTTCGCTGTG TACTATTGCCAGCAGTACGGCTCCTCCTGGACCTTCGGCCAGGGCACCAAGGTGGAAATCAAGTCC |
| 2124 | VL of CDH19 65252.009 | artificial | AA | EIVLTQSPGTLSLSPGERATLSCRASQSVSSSYLAWYQQRPGQAPRLLIYGASSRATGIPDRFSGSGSGTDFTLTISSLEPEDFAV YYCQQYGSSWTFGQGTKVEIKS |
| 2125 | VH-VL of CDH19 65252.009 | artificial | NT | CAGGTGCAGCTGGTGGAATCTGGCGGAGGCTGGTCAGCCTGGCCTCCGAGACTCTGTGCCGCCTCTCAGCTT CTCCTCCTACGACATGGACTGGGTCCGACAGACCCCCGGCAAGGGCCTGGAATGGGTGGCCGTGATTTGGTACGACGGCTCCAACA AGTACTACGCCGACTCCGTGCGGGGCAGATTCACCATCTCCCGGGACAACTCCAAGAACACCCTGTTTCTGCAGATGAACTCCCTG CGGGTGGAAGATACCGCCGTGTACTACTGCGCCAGAGAGACGGAGGCTACCTGTGGGGCCAGGGCACCCTGGT CACCGTGTCTAGCGGCGGAGGCGGATCTGGTGGCGGAGGCTCCAGTGGCGGAGGCTCCGAGATCGTGCTGACCCAGTCCCCTGGCA CCCTGTCCCTGAGCCCTGGCGAGAGAGCCACCCTGTCCTGCAGAGCCCTGAGCGCCACCGGCATCCCTGATCTACGGCGGTTCTCCGG CTCTCCCGGCTCCGGCACCGACTTCACCCTGACCATCAGCTCGCTGGAACCCGAGGACTTCGCTGTGTACTATTGCCAGCAGTACGGCTCCTCT GGACCTTCGGCCAGGGCACCAAGGTGGAAATCAAGTCC |
| 2126 | VH-VL of CDH19 65252.009 | artificial | AA | QVQLVESGGGVVQPGSLRLSCAASGFSFSSYDMDWVRQTPGKGLEWVAVIWYDGSNKYYADSVRGRFTISRDNSKNTLFLQMNSL RVEDTAVYYCARETGEWYFDLWGRGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKS |
| 2127 | CDH19 65252.009 x I2C | artificial | AA | QVQLVESGGGVVQPGSLRLSCAASGFSFSSYDMDWVRQTPGKGLEWVAVIWYDGSNKYYADSVRGRFTISRDNSKNTLFLQMNSL RVEDTAVYYCARETGEWYFDLWGRGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 2128 | CDR-H1 of CDH19 65252.010 | artificial | AA | SYDMD |

TABLE VI-continued

| SEQ ID NO. | DESIGNATION | SOURCE | TYPE | SEQUENCE |
|---|---|---|---|---|
| 2129 | CDR-H2 of CDH19 65252.010 | artificial | AA | VIWYDGSNKYYADSVRG |
| 2130 | CDR-H3 of CDH19 65252.010 | artificial | AA | ETGEGWYFDL |
| 2131 | CDR-L1 of CDH19 65252.010 | artificial | AA | RASQSVSSSYLA |
| 2132 | CDR-L2 of CDH19 65252.010 | artificial | AA | GASSRAT |
| 2133 | CDR-L3 of CDH19 65252.010 | artificial | AA | QQYGSSWT |
| 2134 | VH of CDH19 65252.010 | artificial | NT | CAGGTGCAGCTGGTGGAATCCGGCGGAGGCGTGGTGCAGCCTGGCGGTCCCTGAGACTGTCTTGTGCCGCCTCCGGCTTCAGCTT CTCCTCCTACGACATGGACTGGGTCCGACAGGCCCCAGGCAAGGGCCTGGAATGGGTGGCCGTGATTTGGTACGACGGCTCCAACA AGTACTACGCCGACTCCGTGCGGGGACGAGTTCACCATCTCCCGGGACAACTCCAAGAACACCCTGTTTCTGCAGATGAACTCCCTG CGGGTGGAAGATACCGCCGTGTACTACTGCGCCAGAGAGACAGGCGAGGGCTGGTACTTCGACCTGTGGGGCCAGGGAACCCTGGT CACCGTGTCTAGC |
| 2135 | VH of CDH19 65252.010 | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSS |
| 2136 | VL of CDH19 65252.010 | artificial | NT | GAGATCGTGCTGACCCAGTCCCCTGGCACCCTGTCCCTGAGCCCTGGCGAGAGAGCCACCCTGTCCTGCAGAGCCTCCCAGTCCGT GTCCTCCTCCTACCTGGCCTGGTATCAGCAGAAGCCCGGCCAGGCCCCTCGGCTCCTGATCTACGGCGCCTCTTCCAGAGCCACCG GCATCCCTGACCGGTTCTCCGGCTCTGGCTCCGGCACCGACTTCACCCTGACCATCAGCTCGCTGAACCCGAGGACTTCGCTGTG TACTATTGCCAGCAGTACGGCTCCTCCTGGACCTTCGGCCAGGGCACCAAGGTGGAAATCAAGTCC |
| 2137 | VL of CDH19 65252.010 | artificial | AA | EIVLTQSPGTLSLSPGERATLSCRASQSVSSSYLAWYQQKPGQAPRLLIYGASSRATGIPDRFSGSGSGTDFTLTISSLEPEDFAV YYCQQYGSSWTFGQGTKVEIKS |
| 2138 | VH-VL of CDH19 65252.010 | artificial | NT | CAGGTGCAGCTGGTGGAATCCGGCGGAGGCGTGGTGCAGCCTGGCGGTCCCTGAGACTGTCTTGTGCCGCCTCCGGCTTCAGCTT CTCCTCCTACGACATGGACTGGGTCCGACAGGCCCCAGGCAAGGGCCTGGAATGGGTGGCCGTGATTTGGTACGACGGCTCCAACA AGTACTACGCCGACTCCGTGCGGGGACGAGTTCACCATCTCCCGGGACAACTCCAAGAACACCCTGTTTCTGCAGATGAACTCCCTG CGGGTGGAAGATACCGCCGTGTACTACTGCGCCAGAGAGACAGGCGAGGGCTGGTACTTCGACCTGTGGGGCCAGGGAACCCTGGT CACCGTGTCTAGCGGAGGCGGAGGATCTGGTGGCGGAGGCTCTGGAGGCGGAGGTTCTGAGATCGTGCTGACCCAGTCCCCTGGCA CCCTGTCTAGCCCCGGCGAGAGAGCCACCCTGTCCTGCAGAGCCTCTCAGTCCGTGTCCTCCTCCTACCTGGCCTGGTATCAG CAGAAGCCCGGCCAGGCCCCTCGGCTCCTCATCTACGGCGCCTCTTCCAGAGCCACCGGCATCCCTGACCGGTTCTCCGGCTCTGG CTCCGGCACCGACTTCACCCTGACCATCAGCTCGCTGGAACCCGAGGACTTCGCTGTATATTGCCAGCAGTACGGCTCCTCCT GGACCTTCGGCCAGGGCACCAAGGTGGAAATCAAGTCC |
| 2139 | VH-VL of CDH19 65252.010 | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGRGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKS |

TABLE VI-continued

| SEQ ID NO. | DESIGNATION | SOURCE | TYPE | SEQUENCE |
|---|---|---|---|---|
| 2140 | CDH19 65252.010 x I2C | artificial | AA | QVQLVESGGGVVQPGGSLRLSCAASGFSSYDMDWVRQAPGKGLEWVAVIWYDGSNKYYADSVRGRFTISRDNSKNTLFLQMNSL RVEDTAVYYCARETGEGWYFDLWGRGTLVTVSSGGGSGGGSGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKSGGGGSEVQLVESGGL VQPGGSLKLSCAASGFTFNKYAMNWVRQAPGKGLEWVARIRSKYNNYATYYADSVKDRFTISRDDSKNTAYLQMNLKTEDTAVYY CVRHGNFGNSYISYWAYWGQGTLVTVSPGGTVTLTCGSSTGAVTSGNYPNWVQQKPG VQPGGSLKLSCAASGFTFNKYAMNWVRQAPGKGLEWVARIRSKYNNYATYYADSVKDRFTISRDDSKNTAYLQMNLKTEDTAVYY QAPRGLIGGTKFLAPGTPARFSGSLLGGKAALTLSGVQPEDEAEYYCVLWYSNRWVFGGGTKLTVLHHHHHH |
| 2141 | CDR-H1 of CDH19 65252.011 | artificial | AA | SYDMD |
| 2142 | CDR-H2 of CDH19 65252.011 | artificial | AA | VIWYDGSNKYYADSVRG |
| 2143 | CDR-H3 of CDH19 65252.011 | artificial | AA | ETGEGWYFDL |
| 2144 | CDR-L1 of CDH19 65252.011 | artificial | AA | RASQSVSSSYLA |
| 2145 | CDR-L2 of CDH19 65252.011 | artificial | AA | GASSRAT |
| 2146 | CDR-L3 of CDH19 65252.011 | artificial | AA | QQYGSSWT |
| 2147 | VH of CDH19 65252.011 | artificial | NT | CAGGTGCAGCTGGTGGAATCCGGCGGCGGAGGCGTGGTGCAGCCTGGCGGTGTCCCTGAGACTGTCTTGTGCCGCTTCCGGCTTCAGCTT CTCCTCCTACGACATGGACTGGGTCCGACAGGCCCCTGGCAAGGGCCTGGAATGGGTGGCCGTGATTTGGTACGACGGGCTCCAACA AGTACTACGCCGACTCCGTGCGCGGCAGATTCACCATCTCCCGAGACAACTCCAAGAACACCCTGTTTCTGCAGATGAACTCCCTG CGGGTGGAAGATACCGCCGTGTACTACTGCGCCAGAGAGACCGGAGGGCTGGTACTTCGACCTGTGGGGCCAAGGCACCCTGGT CACCGTGTCTAGC |
| 2148 | VH of CDH19 65252.011 | artificial | AA | QVQLVESGGGVVQPGGSLRLSCAASGFSSYDMDWVRQAPGKGLEWVAVIWYDGSNKYYADSVRGRFTISRDNSKNTLFLQMNSL RVEDTAVYYCARETGEGWYFDLWGQGTLVTVSS |
| 2149 | VL of CDH19 65252.011 | artificial | NT | GAGATCGTGCTGACACCCAGTCCCCTGACACCCTGTCCCTGAGCCCTGGCGAGAGAGCCACCCTGTCCTGCAGAGCCTCCCAGTCCGT GTCCTCCTCCTACCTGGCCTGGTATCAGCAGAAGCCCGGCCAGGCCCCTCGGCTGCTGATCTACGGCGCCTCTTCCAGAGCCACCG GCATCCCCGACCGGTTCTCCGGCTCTGGCTCCGGCACCGACTTCACCCTGACCATCAGCTCCCTGGAACCCGAGGACTTCGCTGTG TACTATTGCCAGCAGTACGGCTCCTCCTGGACCTTCGGCCAGGGCACCAAGGTGGAAATCAAGTCC |
| 2150 | VL of CDH19 65252.011 | artificial | AA | EIVLTQSPGTLSLSPGERATLSCRASQSVSSSYLAWYQQRPGQAPRLLIYGASSRATGIPDRFSGSGSGTDFTLTISSLEPEDFAV YYCQQYGSSWTFGQGTKVEIKS |
| 2151 | VH-VL of CDH19 65252.011 | artificial | NT | CAGGTGCAGCTGGTGGAATCCGGCGGCGGAGGCGTGGTGCAGCCTGGCGGTGTCCCTGAGACTGTCTTGTGCCGCTTCCGGCTTCAGCTT CTCCTCCTACGACATGGACTGGGTCCGACAGGCCCCTGGCAAGGGCCTGGAATGGGTGGCCGTGATTTGGTACGACGGGCTCCAACA AGTACTACGCCGACTCCGTGCGCGGCAGATTCACCATCTCCCGAGACAACTCCAAGAACACCCTGTTTCTGCAGATGAACTCCCTG |

TABLE VI-continued

| SEQ ID NO. | DESIGNATION | SOURCE | TYPE | SEQUENCE |
|---|---|---|---|---|
| | | | | CGGGTGAAGATACCCGCGTGTACTACTGCGCCAGAGAGACAGGCGAGGGCTGGTACTTCGACCTGTGGGGCCAAGGCACCCTGGT CACCGTGTCTAGCGAGGCGGAGAGATCTGTGGCGGAGATTCCTGGCGGCGAGGCCTCTGGGGAGCGTGTTCTGCAGAGATGGTCTCGAGATCCTGAGATCGTGCTGAGATCCCCTGGCA CCCTGTCCCTGAGCCCTGGCCAGGCCACCCTGTCCTGCCGAGCCAGTCCGAGCAGCCAGTCCAGCGTCCTGCTCCTACCTGGTATCAG CAGAGGCCCGGCCAGGCCCCCTCGGCTGCTGATCTACGGCGCTTCCAGAGCCACCATCCCTGACCGGTTCTCCGGCTCTGG CTCCGGCACCGACTTCACCCTGACCATCAGCTCTCTGGAACCCGAGGACTTCGCTGTGTACTATTGCCAGCAGTACGGCTCTCCT GGACCTTCGGCCAGGGCACCAAGGTGGAAATCAAGTCC |
| 2152 | VH-VL of CDH19 65252.011 | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKS |
| 2153 | CDH19 65252.011 x I2C | artificial | AA | QVQLVESGGGVVQPGGSLRLSCAASGFSFSSYDMDWVRQAPGKGLEWVAVIWYDGSNKYYADSVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWVARIRSKYNNYATYYADSVKDRFTISRDDSKNTAYLQMNNLKTEDTAVYY CVRHGNFGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKALTLSGVQPEDEAEYYCVLWYSNRWVFGGGTKLTVLHHHHHH |
| 2154 | CDR-H1 of CDH19 65252.012 | artificial | AA | SYDMD |
| 2155 | CDR-H2 of CDH19 65252.012 | artificial | AA | VIWYEGSNKYYAESVRG |
| 2156 | CDR-H3 of CDH19 65252.012 | artificial | AA | ETGEGWYFDL |
| 2157 | CDR-L1 of CDH19 65252.012 | artificial | AA | RASQSVSSSYLA |
| 2158 | CDR-L2 of CDH19 65252.012 | artificial | AA | GASSRAT |
| 2159 | CDR-L3 of CDH19 65252.012 | artificial | AA | QQYGSSWT |
| 2160 | VH of CDH19 65252.012 | artificial | NT | CAGGTGCAGCTGGTGGAATCCGGCGGAGGCGTGGTGCAGCCTGGCGGGTCCCTGAGACTGTCTTGTGCCGCTCCGGCTTCAGCTT CTCCTCCTACGACATGGACTGGGTCCGACAGGCCCCAGGCAAGGGCCTGGAATGGTGGCCGTGATTTGGTACGAGGGCTCCAACA AGTACTACGCCGAGAGCGTGCGGGGGCAGATTCACCATCTCCCGGACAACTCCAAGAACACCCTGTTTCTGCAGATGAACTCCCTG CGGGTGGAAGATACAGCCGTGTACTACTGCGCCAGAGAGACAGGCGAGGGCTGGTACTTCGACCTGTGGGGCCAAGGCACCCTGGT CACCGTGTCTAGC |
| 2161 | VH of CDH19 65252.012 | artificial | AA | QVQLVESGGGVVQPGGSLRLSCAASGFSFSSYDMDWVRQAPGKGLEWVAVIWYEGSNKYYAESVRGRFTISRDNSKNTLFLQMNSL RVEDTAVYYCARETGEGWYFDLWGQGTLVTVSS |

TABLE VI-continued

| SEQ ID NO. | DESIGNATION | SOURCE | TYPE | SEQUENCE |
|---|---|---|---|---|
| 2162 | VL of CDH19 65252.012 | artificial | NT | GAGATCGTGCTGACCCAGTCCCCTGGCACCCTGAGCCTGTCCCTGCCAGAGCCACCCTGTCCTGCAGAGCTCCCAGTCGT GTCCTCCTACTACCTGGCTTGGTATCAGCAGAGGCCCGGCCAGGCCCCTCGCCTGCTGATCTACGCGCCTTCTCCAGAGCCACCG GCATCCCTGACCGGTTCTCCGGCTCCGGCACCGACTTCACCCTGACCATCAGCTCCCTGGAGCCTGAGGACTTCGCTGTG TACTATTGCCAGCAGTACGGCTCCTCCTGGACCTTCGGCCAAGGTGGACCAAGTCAAGTCC |
| 2163 | VL of CDH19 65252.012 | artificial | AA | EIVLTQSPGTLSLSPGERATLSCRASQSVSSSYLAWYQQRPGQAPRLLIYGASSRATGIPDRFSGSGSGTDFTLTISSLEPEDFAV YYCQQYGSSWTFGQGTKVEIKS |
| 2164 | VH-VL of CDH19 65252.012 | artificial | NT | CAGGTGCAGCTGGTGGAATCCGGCGGAGGCGTGGTGCAGCCTGGCGGTCCGACTGCTCCGACTGCTCCTCCTCCTTGTGCCGCCTCCGGCTTCAGCTT CTCCTCCTACGACATGGACTGGGTCCGACAGGCCCCAGGCAAGGGCCTGGAATGGGTGGCCGTGATTTGGTACGAGGGCTCCAACA AGTACTACGCCGAGTCCGTGCCGGCAGATTCACTCTCCGGACAACTCCAAGAACACCCTGTTTCTGCAGATGAACTCCCTG CGGGTGGAAGATACCGCCGTGTACTACTGCGCCAGAGACAGGCAGGCTGGTACTTCGACCTGGGCGCCAAGGGCACCCTGGT CACCGTGCTTAGCGGAGGCGGAGGATCTGGTGCCGGTGGTGGATCTGGCGGAGGCGGATCTGAGATCGTGCTGACCCAGTCCCCTGGCA CCCTGTCCCTGAGCCCTGGAGAGCGGGCCACCCTGCTCAGCTGCAGGCGGTCCTGTATCAGCTGTAGTGGAATCGGTTCTCCGGCTATCAG CAGAGGCCCGGCCAGGCCCCTAGGCTGCTGATCTACGGCGCCCAGAGCCGGGCCACCGGCATCCCTGACCGGTTCTCCGGCTATCAG CCTCCGGACCGACTTCACCCTGACCATCAGCTCGCTGGAGAACCCGGCAGGGACTTCGCTGTGTACTATTGCCAGCAGTACGGCTCCTCCT GGACCTTCGGCCAGGGCACCAAGGTGGAAATCAAGTCC |
| 2165 | VH-VL of CDH19 65252.012 | artificial | AA | QVQLVESGGGVVQPGGSLRLSCAASGFSSSYDMDWVRQAPGKGLEWVAVIWYEGSNKYYAESVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKS |
| 2166 | CDH19 65252.012 x I2C | artificial | AA | QVQLVESGGGVVQPGGSLRLSCAASGFSSSYDMDWVRQAPGKGLEWVAVIWYEGSNKYYAESVRGRFTISRDNSKNTLFLQMNSL RVEDTAVYYCARETGEGWYFDLWGQGTLVTVSSGGGGSGGGGSGGGGSEIVLTQSPGTLSLSPGERATLSCRASQSVSSSYLAWYQ QRPGQAPRLLIYGASSRATGIPDRFSGSGSGTDFTLTISSLEPEDFAVYYCQQYGSSWTFGQGTKVEIKSGGGGSEVQLVESGGGL VQPGGSLKLSCAASGFTFNKYAMNWVRQAPGKGLEWVARIRSKYNNYATYADSVKDRFTISRDDSKNTAYLQMNNLKTEDTAVYY CVRHGNFPGNSYISYWAYWGQGTLVTVSSGGGGSGGGGSGGGGSQTVVTQEPSLTVSPGGTVTLTCGSSTGAVTSGNYPNWVQQKPG QAPRGLIGGTKFLAPGTPARFSGSLLGGKAALTLSGVQPEDEAEYYCVLWYSNRWVFGGGTKLTVLHHHHHH |
| 2167 | CDR-H1 of CDH19 65253.003 | artificial | AA | SYSWS |
| 2168 | CDR-H2 of CDH19 65253.003 | artificial | AA | YIYYSGSTNYNPSLKS |
| 2169 | CDR-H3 of CDH19 65253.003 | artificial | AA | NWAFHFDY |
| 2170 | CDR-L1 of CDH19 65253.003 | artificial | AA | TGSSNIGTGYDVH |
| 2171 | CDR-L2 of CDH19 65253.003 | artificial | AA | GNSNRPS |

TABLE VI-continued

| SEQ ID NO. | DESIGNATION | SOURCE | TYPE | SEQUENCE |
|---|---|---|---|---|
| 2172 | CDR-L3 of CDH19 65253.003 | artificial | AA | QSYESSLSGWV |
| 2173 | VH of CDH19 65253.003 | artificial | NT | CAGGTGCAGCTGCAGGAATCCGGCCCTGGTCAAGCCCTCCGACCTGTCCCTGACCTGCACCGTGACCGGCTCCAT CTCCTCCTACTCTTGGTCCTGGATCCGGCAGCCCCCTGGCAAGGGCCTGGAATGATCGGCTACATCTACTACTCCGGCTCCACCA ACTACAACCCCAGCCTGAAGTCCAGATGACCATCTCCCTGGACACCTCCAAGAACCAGTTCTCCCTGAAGCTGTCCTCCGTGACC GCCGCTGACACCGCCGTGTACTACTGCGCCCGGAACTGGGCCTTCCACTTCGACTACTGGGGCCAGGGCACCCTGGTCACCGTGTC TAGC |
| 2174 | VH of CDH19 65253.003 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSS |
| 2175 | VL of CDH19 65253.003 | artificial | NT | CAGTCTGTGCTGACCCAGCCTCCCTCTGTGTCTGGGGCTCCAGGCCGTCAGCGCGTGACCATTTCCTGCACCGGCTCCTCCAGCAACAT CGGCACCGGCTACGACGTGCACTGGTATCAGCAGCTGCCCGGCACCGCCCCAAGCTGCTGATCTACGGCAACTCCAACCGGCCCT CCGGCGTGCCCGACCGGTTCTCTGGCTCCAAGTCTGGCACCTCCGCCTCTCTGGCCATCACCGGACTGCAGGCTGAGGACGAGGCC GACTACTACTGCCAGTCCTACGAGTCCTCCCTGTCCGGCTGGGTGTTCGGCGGAGGCACCAAACTGACCGTGCTGTCC |
| 2176 | VL of CDH19 65253.003 | artificial | AA | QSVLTQPPSVSGAPGQRVTISCTGSSSNIGTGYDVHWYQQLPGTAPKLLIYGNSNRPSGVPDRFSGSKSGTSASLAITGLQAEDEA DYYCQSYESSLSGWVFGGGTKLTVLS |
| 2177 | VH-VL of CDH19 65253.003 | artificial | NT | CAGGTGCAGCTGCAGGAATCCGGCCCTGGTCAAGCCCTCCGACCTGTCCCTGACCTGCACCGTGACCGGCTCCAT CTCCTCCTACTCTTGGTCCTGGATCCGGCAGCCCCCTGGCAAGGGCCTGGAATGATCGGCTACATCTACTACTCCGGCTCCACCA ACTACAACCCCAGCCTGAAGTCCCGGGTGACCATCTCCCTGGACACCTCCAAGAACCAGTTCTCCCTGAAGCTGTCCTCCGTGACC GCCGCTGACACCGCCGTGTACTACTGCGCCCGGAACTGGGCCTTCCACTTCGACTACTGGGGTCAGGGCACCCTGGTCACCGTGTC TAGCGGAGGCGGAGGATCTGGTGGCGGTGGTTCTGGCGGCGGAGGCTCTGGCGGAGGTGGCTCCCAGTCTGTGCTGACCCAGCCTC CCCCTGGCCAGCGCGTGACCATTTCCTGCACCGGCTCTTCCAGCAACATCGGCACCGGCTACGACGTGCACTGGTATCAGCAGCTG CCCGGCACCGCCCCCAAGCTGCTGATCTACGGCAACTCCAACCGGCCCTCCGGCGTTCCCGACCGGTTCTCTGGCTCCAAGTCTGG CACCTCCGCCTCTCTGGCCATCACCGGACTGCAGGCTGAGGACGAGGCCGACTACTACTGCCAGTCCTACGAGTCCTCCCTGTCCG GCTGGGTGTTCGGCGGAGGCACCAAACTGACCGTGCTGTCC |
| 2178 | VH-VL of CDH19 65253.003 | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL PGTAPKLLIYGNSNRPSGVPDRFSGSKSGTSASLAITGLQAEDEADYYCQSYESSLSGWVFGGGTKLTVLS |
| 2179 | CDH19 65253.003 x I2C | artificial | AA | QVQLQESGPGLVKPSETLSLTCTVSGGSISSYSWSWIRQPPGKGLEWIGYIYYSGSTNYNPSLKSRVTISLDTSKNQFSLKLSSVT AADTAVYYCARNWAFHFDYWGQGTLVTVSSGGGGSGGGGSGGGGSQSVLTQPPSVSGAPGQRVTISCTGSSSNIGTGYDVHWYQQL PGTAPKLLIYGNSNRPSGVPDRFSGSKSGTSASLAITGLQAEDEADYYCQSYESSLSGWVFGGGTKLTVLSGGGGSEVQLVESGGG LVQPGGSLKLSCAASGFTFNKYAMNWVRQAPGKGLEWVARIRSKYNNYATYYADSVKDRFTISRDDSKNTAYLQMNNLKTEDTAVY YCVRHGNFGNSYISTWAYWGQGTLVTVSSGGGGSGGGGSGGGGSQTVVTQEPSLTVSPGGTVTLTCGSSTGAVTSGNYPNWVQQKP GQAPRGLIGGTKFLAPGTPARPSGSLLGGKAALTLSGVQPEDEAEYYCVLWYSNRWVFGGGTKLITVLHHHHHH |
| 2180 | CDR-H1 of CDH19 65254.001 | artificial | AA | SYGMH |
| 2181 | CDR-H2 of CDH19 65254.001 | artificial | AA | FIWYDGSNKYYADSVKD |

TABLE VI-continued

| SEQ ID NO. | DESIGNATION | SOURCE | TYPE | SEQUENCE |
|---|---|---|---|---|
| 2182 | CDR-H3 of CDH19 65254.001 | artificial | AA | RAGIIGTIGYYYGMDV |
| 2183 | CDR-L1 of CDH19 65254.001 | artificial | AA | SGDRLGEKYTS |
| 2184 | CDR-L2 of CDH19 65254.001 | artificial | AA | QDTKRPS |
| 2185 | CDR-L3 of CDH19 65254.001 | artificial | AA | QAWDSSTVV |
| 2186 | VH of CDH19 65254.001 | artificial | NT | CAGGTGCAGCTGGTGGAATCCGGCGGAGGCTGGTCAGCCTGGCGCCGGTCCTGAGACTGTCTTCGCCCGCTCCGGCTTCACCTT CTCCAGCTACGGCATGCACTGGGTCCGACAGGCCCCTGGCAAGGGCCTGGAATGGGTGGCCTTCATTTGGTACGACGGCTCCAACA AGTACTACGCCGACTCCGTGAAGGACCGGTTCACCATCTCCGGAGACAACTCCAAGAACACCCTGTACCTGCAGATGAAGTCCCTG CGGGCCGAGGACACCGCCGTGTACTACTGTGCCAGAGGGCCGGACATCATCGGCACTATCGGCTACTACTACGGCATGGACGTGTG GGGCCAGGGCACCACCGTGACCGTGTCTAGC |
| 2187 | VH of CDH19 65254.001 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSS |
| 2188 | VL of CDH19 65254.001 | artificial | NT | TCTTACGAGCTGACCCAGCCCCCCTCCGTGTCTGTCGCTCCAGTGGGCCAGAGGGTGACCATCTCCTGTTCTGGCGACCGGCTGGGCGA GAAGTACACCAGCTGGTATCAGCAGCGGCCTGGCCAGGCCCCTGTGCTGGTGATCTACCAGGACACCAAGCGCCCTCCGGCATCC CTGAGCGGTTCTCCGGCTCCAACTCCGGCACAGCCACCCTGACCATCTCCGGACTCCAGGCCGAGGCCGATTACTACTGCCAGGCC TGCCAGCCTGGTTCGGCGAGGCACCAAGCTGACCGTGCTGTCC |
| 2189 | VL of CDH19 65254.001 | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWDSSTVVFGGGTKLTVLS |
| 2190 | VH-VL of CDH19 65254.001 | artificial | NT | CAGGTGCAGCTGGTGGAATCCGGCGGAGGCTGGTCAGCCTGGCGCCGGTCCTGAGACTGTCTTCGCCCGCTCCGGCTTCACCTT CTCCAGCTACGGCATGCACTGGGTCCGACAGGCCCCTGGCAAGGGCCTGGAATGGGTGGCCTTCATTTGGTACGACGGCTCCAACA AGTACTACGCCGACTCCGTGAAGGACCGGTTCACCATCTCCGGAGACAACTCCAAGAACACCCTGTACCTGCAGATGAAGTCCCTG CGGGCCGAGGACACCGCCGTGTACTACTGTGCCAGAGGGCCGGACATCATCGGCACTATCGGCTACTACTACGGCATGGACGTGTG GGGCCAGGGCACCACCGTGACCGTGTCTTCTTACGAGC TGACCCAGCCCCCCTCCGTGTCTGTCGCTCCAGTGGGCCAGAGGGTGACCATCTCCTGTTCTGGCGACCGGCTGGGCGAGAAGTACACC AGTTGGTATCAGCAGCGGCCTGGCCAGGCCCCTGTGCTGGTCATCTACCAGGACACCAAGCGCCCTCCGGCATCCCTGAGCGGTT CTCCGGCTCCAACTCCGGCACAGCCACCCTGACCATCTCCGGACTCCAGGCCGAGGCCGACTACTACTGCCAGGCCT GGGACTCCTCCACCGTGGTTCGGCGAGGCACCAAGCTGACCGTGCTGTCC |
| 2191 | VH-VL of CDH19 65254.001 | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWDSSTVVFGGGTKLTVLS |
| 2192 | CDH19 65254.001 x I2C | artificial | AA | QVQLVESGGGVVQPGRSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWDSSTVVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED |

TABLE VI-continued

| SEQ ID NO. | DESIGNATION | SOURCE | TYPE | SEQUENCE |
|---|---|---|---|---|
| | | | | TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLHHHHHH |
| 2193 | CDR-H1 of CDH19 65254.003 | artificial | AA | SYGMH |
| 2194 | CDR-H2 of CDH19 65254.003 | artificial | AA | FIWYDGSNKYYADSVKD |
| 2195 | CDR-H3 of CDH19 65254.003 | artificial | AA | RAGIIGTIGYYYGMDV |
| 2196 | CDR-L1 of CDH19 65254.003 | artificial | AA | SGDRLGEKYTS |
| 2197 | CDR-L2 of CDH19 65254.003 | artificial | AA | QDTKRPS |
| 2198 | CDR-L3 of CDH19 65254.003 | artificial | AA | QAWDSSTVV |
| 2199 | VH of CDH19 65254.003 | artificial | NT | CAGGTGCAGCTGGTGGAATCCGGCGGAGGCCTGGTCCAGCCTGGCGGGTCCCTGCGCCTCTCCTGTGCCGCCTCCGGCTTCACCTT CTCCAGCTACGGCATGCACTGGGTCCGACAGGCCCCTGGAAGGCCTGGAATGGGTGGCCTTCATTTGGTACGACGGCTCCAACA AGTACTACGCCGACTCCGTGAAGGACCGGTTCACCATCTCCCGGGACAACTCCAAGAACACCCTGTACCTGCAGATGAAGTCCCTG CGGGCCGAGGACACCGCCGTGTACTACTGTGCCAGAGGGCCGGCATCATCGGCACCATCGGCTACTACTACGGCATGGACGTGTG GGGCCAAGGGACCACCGTCACCGTCTCGAGC |
| 2200 | VH of CDH19 65254.003 | artificial | AA | QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSS |
| 2201 | VL of CDH19 65254.003 | artificial | NT | TCTTACGAGCTGACCCAGCCCCCCTCCGTGTCTGTCAGCCCCGGGCAGACGGCCAGCATCACCTGTTCTGGCGACCGGCTGGGCGA GAAGTACACCAGTTGGTATCAGCAGCCCCTGGCCAGTCCCCGTGCTCATCTACCAGGACACCAAGCGGCCCTCCGGCATCC CTGAGCGCCGTTCTCCGGCTCCAACCTCCACCGTGGCTGTTTCGGCGGAGGCACCCAGCTGACCGTGCTCTCC TGCCAGGCCTGGGACTCCTCCACCGTGGTGTTCGGCGGAGGCACCCAGCTGACCGTGCTGTCC |
| 2202 | VL of CDH19 65254.003 | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWDSSTVVFGGGTKLTVLS |
| 2203 | VH-VL of CDH19 65254.003 | artificial | NT | CAGGTGCAGCTGGTGGAATCCGGCGGAGGCCTGGTCCAGCCTGGCGGGTCCCTGCGCCTCTCCTGTGCCGCCTCCGGCTTCACCTT CTCCAGCTACGGCATGCACTGGGTCCGACAGGCCCCTGGAAGGCCTGGAATGGGTGGCCTTCATTTGGTACGACGGCTCCAACA AGTACTACGCCGACTCCGTGAAGGACCGGTTCACCATCTCCCGGGACAACTCCAAGAACACCCTGTACCTGCAGATGAAGTCCCTG CGGGCCGAGGACACCGCCGTGTACTACTGTGCCAGAGGGCCGGCATCATCGGCACCATCGGCTACTACTACGGCATGGACGTGTG GGGCCAAGGGACCACCGTCACCGTCTCCTCCGGCGGAGGCGGAAGTGGTGGCGGTGGTTCTGGCGGCGGAGGCTCCTCTTACGAG CTGACCCAGCCCCCCTCCGTGTCTGTCTCCCCAGGCCAGACCGCCTCCATCACCTGTTCTGGCGACCGGCTGGGCGAGAAGTACACC AGTTGGTATCAGCAGCCCCTGGCCAGTCCCCGTGCTCATCTACCAGGACACCAAGCGGCCCTCCGGCATCCCTGAGCGGTT |

TABLE VI-continued

| SEQ ID NO. | DESIGNATION | SOURCE | TYPE | SEQUENCE |
|---|---|---|---|---|
| 2204 | VH-VL of CDH19 65254.003 | artificial | AA | CTCCGGCTCCAACTCCGGCAACACCGCCACCTGACCATTCCGGCACCCAGGCCATGACGAGGCCGACTACTACTGCCAGGCCT GGGACTCCTCCACCGTGGTGTTCGGCGGAGGCACCAAGCTGACCGTGCTGTCC QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWDSSTVFGGGTKLTVLS |
| 2205 | CDH19 65254.003 x I2C | artificial | AA | QVQLVESGGGVVQPGGSLRLSCAASGFTFSSYGMHWVRQAPGKGLEWVAFIWYDGSNKYYADSVKDRFTISRDNSKNTLYLQMKSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWDSSTVFGGGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVPEDEAEYYCVLWYSNRWVFGGGTKLTVLHHHHHH |
| 2206 | CDR-H1 of CDH19 65254.007 | artificial | AA | SYGMH |
| 2207 | CDR-H2 of CDH19 65254.007 | artificial | AA | FIWYEGSNKYYAESVKD |
| 2208 | CDR-H3 of CDH19 65254.007 | artificial | AA | RAGIIGTIGYYYGMDV |
| 2209 | CDR-L1 of CDH19 65254.007 | artificial | AA | SGDRLGEKYTS |
| 2210 | CDR-L2 of CDH19 65254.007 | artificial | AA | QDTKRPS |
| 2211 | CDR-L3 of CDH19 65254.007 | artificial | AA | QAWESSTVV |
| 2212 | VH of CDH19 65254.007 | artificial | NT | CAGGTGCAGCTGGTGGAATCCGGCGGAGGCGTGGTGCAGCCTGGCGGCTCCGGAGCCTGGAGACTGTCTTGCGCCGCTTCACCTT CTCCAGCTACGGCATGCACTGGGTCCGACAGGCCCCTGGCAAGGGCCTGGAATGGGTGGCCTTCATTTGGTACGAGGGCTCCAACA AGTACTACGCCGAGGACAGCGTGAAGGACCGGTTCACCATCTCCCGGGACAACTCCAAGAACACCCTGTACCTGCAGATGAATTCCCTG CGGGCCGAGGACACCGCCGTGTACTACTGTGCCAGAAGGGCCGGCATCATCGGCACCATCGGCTACTACTACGGCATGGACGTGTG GGGCCAGGGCACCACCGTGACCGTGTCTAGC |
| 2213 | VH of CDH19 65254.007 | artificial | AA | QVQLVESGGGVVQPGGSLRLSCAASGFTFSSYGMHWVRQAPGKGLEWVAFIWYEGSNKYYAESVKDRFTISRDNSKNTLYLQMNSL RAEDTAVYYCARRAGIIGTIGYYYGMDVWGQGTTVTVSS |
| 2214 | VL of CDH19 65254.007 | artificial | NT | TCTTACGAGCTGACCCAGCCCCCTCCGTCTCCGTGTCCGGCCAGACCGCCTCCATCACCTGTTCTGGCGACCGGCTGGGCGA GAAGTACACCAGTTGGTATCAGCAGCGCCTGGCCAGTCCCCCTGCTGGTCATCTACCAGGACACCAAGCGCCTCCGGCATCC CTGAGCGGTTCTCCGGCTCCAACTCCGGCACCACCCTGACCATCTCCGGCACCCAGGCCATGGACGAGGCCGACTACTAC TGCCAGGCCTGGGAGTCCTCCACCGTGGTGTTCGGCGGAGGCACCAAGCTGACCGTGCTGTCC |

TABLE VI-continued

| SEQ ID NO. | DESIGNATION | SOURCE | TYPE | SEQUENCE |
|---|---|---|---|---|
| 2215 | VL of CDH19 65254.007 | artificial | AA | SYELTQPPSVSVSPGQTASITCSGDRLGEKYTSWYQQRPGQSPLLVIYQDTKRPSGIPERFSGSNSGNTATLTISGTQAMDEADYY CQAWESSTVVFGGGTKLTVLS |
| 2216 | VH-VL of CDH19 65254.007 | artificial | NT | CAGGTGCAGCTGGTGCAGAGTCCGGCGGAGGCCTGGTGCAGCCTGGGCGGTCCCTGAGACTGTCTTGCGCCGCTCCGGCTTCACCTT CTCCAGCTACGGCATGCACTGGGTCCGACAGGCCCCTGGCAAGGGCTCCGAAGTGGTGGCCTTCATTTGGTACGAGGGCTCCAACA AGTACTACGCCGAGTCCGTGAAGGACCGGTTCACCATCTCCAGAGACAACTCCAAGAACACCCTGTACCTGCAGATGAATTCCCTG CGGGCCGAGGACACCGCCGTGTACTACTGTGCCAGAGGCATCATCGGCACTACCATCGGCTACTACTACGGCATGGACGTGTG GGGCCAGGCACCACCGTGACCGTGTCTAGCGAGGTGCAGCTGCTGGAGTCTGGCGGCGGATCTGGCGGAGGCTCCTCTTACGAGC TGACCCAGCCCCCTTCCGTGTCTGTGTCTCCTGGCCAGACCGCCTCCATCACCTGTTCTGGCGACCGGCTGGGCGAGAAGTACACC AGTTGGTATCAGCAGCGGCCTGGCCAGTCCCCCCTGCTGGTCATCTACCAGGACACCAAGCGGCCCTCCGGCATCCTGAGCGGTT CTCCGGCTCCAACTCCGGCAACACCGCCACCCTGACCATCTCCGGCACCCAGGCCATGGACGAGGCCGACTACTACTGCCAGGCCT GGGAGTCCTCCACCGTGTTCGGCGAGGCACCAAGCTGACCGTGCTGTCC |
| 2217 | VH-VL of CDH19 65254.007 | artificial | AA | QVQLVESGGGVVQPGGSLRLSCAASGFTFSSYGMHWVRQAPGKGLEWVAFIWYEGSNKYYAESVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGTKLTVLS |
| 2218 | CDH19 65254.007 x I2C | artificial | AA | QVQLVESGGGVVQPGGSLRLSCAASGFTFSSYGMHWVRQAPGKGLEWVAFIWYEGSNKYYAESVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGGGGSGGGGSEVQLVE SGGGLVQPGGSLKLSCAASGFTFNKYAMNWVRQAPGKGLEWVARIRSKYNNYATYYADSVKGRFTVTSRDDSKNTAYLQMNNLKTED TAVYYCVRHGNFGNSYISYNAYWGQGTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGG QRFCTGHFGGLHPCNGHHHHHH |
| 2219 | CDH19 14302 CC x I2C-LFcBγ | artificial | aa | QRFVTGHFGGLYPANGGGGSQVQLVESGGGVVQPGGSLRLSCAASGFTFSSYGMHWVRQAPGKCLEWVAFIWYDGSNKYYADSVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYNAYWGQGTLVTVSSGGGGSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGS QRFCTGHFGGLHPCNGHHHHHH |
| 2220 | CDH19 14302 CC x I2C-LFcBγ-156 | artificial | aa | QRFVTGHFGGLYPANGGGGSQVQLVESGGGVVQPGGSLRLSCAASGFTFSSYGMHWVRQAPGKCLEWVAFIWYDGSNKYYADSVK DRFTISRDNSKNTLYLQMNSLRAEDTAVYYCARRAGIIGTIGYYYGMDVWGQGTTVTVSSGGGGSGGGGSSYELTQPPSVS VSPGQTASITCSGDRLGEKYTSWYQQRPGQSPLLVIYQDTKRPSGIPERFSGSNSGNTATLTISGTQAMDEADYYCQAWESSTVVF GCGTKLTVLSGGGGSEVQLVESGGGLVQPGGSLKLSCAASGFTFNKYAMNWVRQAPGKGLEWVARIRSKYNNYATYYADSVKDRFT ISRDDSKNTAYLQMNNLKTEDTAVYYCVRHGNFGNSYISYNAYWGQGTLVTVSSGGGGSGGGGSGGGGSQTVVTQEPSLTVSPGGT VTLTCGSSTGAVTSGNYPNWVQQKPGQAPRGLIGGTKFLAPGTPARFSGSLLGGKAALTLSGVQPEDEAEYYCVLWYSNRWVFGGG TKLTVLGGGGS GGGGS RDWDFDVFGGGTPVGGHHHHHH |
| 2221 | CDH19 14302 CC x I2C-Cys-Loop | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDSKNTAYLQMNNLKTED TAVYYCVRHGNFGNSYISYNAYWGQGTLVTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLGGCGGGHHHHHH |
| 2222 | CDH19 14302 CC x I2C-HALB | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE |

TABLE VI-continued

| SEQ ID NO. | DESIGNATION | SOURCE | TYPE | SEQUENCE |
|---|---|---|---|---|
| 2223 | CDH19 14302 CC x I2C-GS-D3HSA | artificial | aa | SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLPGGGGSDAHKSEVAH RFKDLGEENFKALVLIAFAQYLQQCPEEDHVKLVNEVTEFAKTCVADESAENCDKSLHTLFGDKLCTVATLRETYGEMADCCAKQE PERNECFLQHDDNPNLPRLVRPEVDVMCTAFHDNEETFLKKYLYEIARRHPYFYAPELLFPAKRYKAAFTECCQAADKAACLLPK LDELRDEGKASSAKQRLKCASLQKFGERAFKAWAVARLSQRFPKAEFAEVSKLVTDLTKVHTECCHGDLLECADDRADLAKYICEN QDSISSKLKECCEKPLLEKSHCIAEVENDEMPADLPSLAADFVESKDVCKNYAEAKDVFLGMFLYEYARRHPDYSVLLLRLAKTY ETTLEKCCAAADPHECYAKVFDEFKPLVEERPQNLIKQNCELFEQLGEYKFQNALLVRYTKKVPQVSTPTLVEVSRNLGKVGSKCCK HPEAKRMPCAEDYLSVVLNQLCVLHEKTPVSDRVTKCCTESLVNRRPCFSALEVDETYVPKEFNAETFTFHADICTLSEKERQIKK QTALVELVKHKPKATKEQLKAVMDDFAAFVEKCCKADDKETCFAEEGKKLVAASQAALGLDYHHHHHH |
| 2224 | CDH19 14302 CC x I2C-3GS-D3HSA | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLPGGGGSEEPQNLIKQ NCELFEQLGEYKFQNALLVRYTKKVPQVSTPTLVEVSRNLGKVGSKCCKHPEAKRMPCAEDYLSVVLNQLCVLHEKTPVSDRVTKC CTESLVNRRPCFSALEVDETYVPKEFNAETFTFHADICTLSEKERQIKKQTALVELVKHKPKATKEQLKAVMDDFAAFVEKCCKAD DKETCFAEEGKKLVAASQAALGLHHHHHH |
| 2225 | CDH19 14302 CC x I2C-GS-D3HSA-156 | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLPGGGGSEEPQNLIKQ NCELFEQLGEYKFQNALLVRYTKKVPQVSTPTLVEVSRNLGKVGSKCCKHPEAKRMPCAEDYLSVVLNQLCVLHEKTPVSDRVTKC CTESLVNRRPCFSALEVDETYVPKEFNAETFTFHADICTLSEKERQIKKQTALVELVKHKPKATKEQLKAVMDDFAAFVEKCCKAD DKETCFAEEGKKLVAASQAALGL GGGGSGGGS RDWDFDVFGGGTPVGG HHHHHH |
| 2226 | CDH19 14302 CC x I2C-3GS-D3HSA-156 | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYYADSVKDRFTISRDDSKNTAYLQMNNLKTED TAVYYCVRHGNFGNSYISYWAYWGQQTLVTVSSGGGGSGGGGSGGGGSQTVVTQEPSLTVSPGGTVTLTCGSSTGAVTSGNYPNWV QQKPGQAPRGLIGGTKFLAPGTPARFSGSLLGGKAALTLSGVQPEDEAEYCVLWYSNRWVFGGGTKLTVLPGGGGSEEPQNLIKQ SEEPQNLIKQNCELFEQLGEYKFQNALLVRYTKKVPQVSTPTLVEVSRNLGKVGSKCCKHPEAKRMPCAEDYLSVVLNQLCVLHEK TPVSDRVTKCCTESLVNRRPCFSALEVDETYVPKEFNAETFTFHADICTLSEKERQIKKQTALVELVKHKQTALVELVKHKPKATKEQLKAVMDDFA AFVEKCCKADDKETCFAEEGKKLVAASQAALGL GGGGSGGGS RDWDFDVFGGGTPVGG HHHHHH |

TABLE VI-continued

| SEQ ID NO. | DESIGNATION | SOURCE | TYPE | SEQUENCE |
|---|---|---|---|---|
| 2227 | CDH19 14302 CC x I2C-GS-D3HSA-21 | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSQTVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLPGGGSEEPQNLIKQ NCELFEQLGEYKFQNALLVRYTKKVPQVSTPTLVEVSRNLGKVGSKCCKHPEAKRMPCAEDYLSVVLNQLCVLHEKTPVSDRVTKC CTESLVNRRPCFSALEVDETVVPKEFNAETFTFHADICTLSEKERQIKKQTALVELVKHKPKATKEQLKAVMDDFAAFVEKCCKAD DKETCFAEEGKKLVAASQAALGL GGGGSGGGS RLIEDICLPRWGCLWEDD HHHHHH |
| 2228 | CDH19 14302 CC x I2C-3GS-D3HSA-21 | artificial | aa | QVQLVESGGGVVQPGGSLRLSCAASGFTFSSYGMHWVRQAPGKCLEWVAFIWYDGSNKYYADSVKDRFTISRDNSKNTLYLQMNSL RAEDTAVYYCARRAGIIGTIGYYYGMDVWGQGTTVTVSSGGGGSGGGGSGGGGSSYELTQPPSVSVSPGQTASITCSGDRLGEKYT SWYQQRPGQSPLLVIYQDTKRPSGIPERFSGSNSGNTATLTISGTQAMDEADYYCQAWESSTVVFGCGTKLTVLSGGGGSEVQLVE SGGGLVQPGGSLKLSCAASGFTFNKYAMNWVRQAPGKGLEWVARIRSKYNNYATYADSVKDRFTISRDDSKNTAYLQMNNLKTED TAVYYCVRHGNFGNSYISYWAYWGQGTLVTVSSGGGGSGGGGSQTVTQEPSLTVSPGGTVTLTCGSSTGAVTSGNYPNWV QQKPGQAPRGLIGGTKFLAPGTPARFSGSLLGGKAALTLSGVQPEDEAEYYCVLWYSNRWVFGGGTKLTVLPGGGSGGGGSGGGG SEEPQNLIKQNCELFEQLGEYKFQNALLVRYTKKVPQVSTPTLVEVSRNLGKVGSKCCKHPEAKRMPCAEDYLSVVLNQLCVLHEK TPVSDRVTKCCTESLVNRRPCFSALEVDETYVPKEFNAETFTFHADICTLSEKERQIKKQTALVELVKHKPKATKEQLKAVMDDFA AFVEKCCKADDKETCFAEEGKKLVAASQAALGL GGGGSGGGS RLIEDICLPRWGCLWEDD HHHHHH |

SEQUENCE LISTING (2228 sequences)

SEQ ID NO: 1 - DNA, 15 bp, artificial
  1D10, 2C12 - CDR-H1
agctatggcatgcac

SEQ ID NO: 2 - DNA, 51 bp, artificial
  1D10, 2C12 - CDR-H2
gttatatggtatgatggaagtaataaatactatgcagactccgtgaagggc

SEQ ID NO: 3 - DNA, 48 bp, artificial
  1D10, 2C12 - CDR-H3
agggccggtataataggaactacaggctactactacggtatggacgtc

SEQ ID NO: 4 - protein, 5 aa, artificial
  1D10, 2C12 - CDR-H1
SYGMH

SEQ ID NO: 5 - protein, 17 aa, artificial
  1D10, 2C12 - CDR-H2
VIWYDGSNKYYADSVKG

SEQ ID NO: 6 - protein, 16 aa, artificial
  1D10, 2C12 - CDR-H3
RAGIIGTTGYYYGMDV

SEQ ID NO: 7 - DNA, 21 bp, artificial
  1F10 - CDR-H1
agtggtggttactactggagc

SEQ ID NO: 8 - DNA, 48 bp, artificial
  1F10 - CDR-H2
tacatctattacagtgggagcacctactacaacccgtccctcacgagt

SEQ ID NO: 9 - DNA, 30 bp, artificial
  1F10 - CDR-H3
gatggaagcagtggctggtacttccagcac

SEQ ID NO: 10 - protein, 7 aa, artificial
  1F10 - CDR-H1
SGGYYWS

SEQ ID NO: 11 - protein, 16 aa, artificial
  1F10 - CDR-H2
YIYYSGSTYYNPSLTS

SEQ ID NO: 12 - protein, 10 aa, artificial
  1F10 - CDR-H3
DGSSGWYFQH

SEQ ID NO: 13 - DNA, 15 bp, artificial
  2C12_LC#1 - CDR-H1
agctatggcatgcac

SEQ ID NO: 14 - DNA, 51 bp, artificial; identical to SEQ ID NO: 2
  2C12_LC#1 - CDR-H2

SEQ ID NO: 15 - DNA, 48 bp, artificial; identical to SEQ ID NO: 3
  2C12_LC#1 - CDR-H3

SEQ ID NO: 16 - protein, 5 aa, artificial
  2C12_LC#1 - CDR-H1
SYGMH

SEQ ID NO: 17 - protein, 17 aa, artificial
  2C12_LC#1 - CDR-H2
VIWYDGSNKYYADSVKG

SEQ ID NO: 18 - protein, 16 aa, artificial
  2C12_LC#1 - CDR-H3
RAGIIGTTGYYYGMDV

SEQ ID NO: 19 - DNA, 15 bp, artificial
  2G6_LC#1 - CDR-H1
agctatggcatgcac

SEQ ID NO: 20 - DNA, 51 bp, artificial
  2G6_LC#1 - CDR-H2
tttatatggtatgatggaagtaataaatactatgcagactccgtgaaggac

SEQ ID NO: 21 - DNA, 48 bp, artificial
  2G6_LC#1 - CDR-H3
agggccggtataataggaactataggctactactacggtatggacgtc

SEQ ID NO: 22 - protein, 5 aa, artificial
  2G6_LC#1 - CDR-H1
SYGMH

SEQ ID NO: 23 - protein, 17 aa, artificial
  2G6_LC#1 - CDR-H2
FIWYDGSNKYYADSVKD

SEQ ID NO: 24 - protein, 16 aa, artificial
  2G6_LC#1 - CDR-H3
RAGIIGTIGYYYGMDV

SEQ ID NO: 25 - DNA, 15 bp, artificial
  2G6 - CDR-H1
agctatggcatgcac

SEQ ID NO: 26 - DNA, 51 bp, artificial; identical to SEQ ID NO: 20
  2G6 - CDR-H2

SEQ ID NO: 27 - DNA, 48 bp, artificial; identical to SEQ ID NO: 21
  2G6 - CDR-H3

SEQ ID NO: 28 - protein, 5 aa, artificial
  2G6 - CDR-H1
SYGMH

SEQ ID NO: 29 - protein, 17 aa, artificial
  2G6 - CDR-H2
FIWYDGSNKYYADSVKD

SEQ ID NO: 30 - protein, 16 aa, artificial
  2G6 - CDR-H3
RAGIIGTIGYYYGMDV

SEQ ID NO: 31 - DNA, 15 bp, artificial
  2H12 - CDR-H1
agctatggcatgcac

SEQ ID NO: 32 - DNA, 51 bp, artificial
  2H12 - CDR-H2
gttatatggtatgatggaagtaataaatactatacagactccgtgaagggc

SEQ ID NO: 33 - DNA, 48 bp, artificial; identical to SEQ ID NO: 3
  2H12 - CDR-H3

SEQ ID NO: 34 - protein, 5 aa, artificial
  2H12 - CDR-H1
SYGMH

SEQ ID NO: 35 - protein, 17 aa, artificial
  2H12 - CDR-H2
VIWYDGSNKYYTDSVKG

SEQ ID NO: 36 - protein, 16 aa, artificial
  2H12 - CDR-H3
RAGIIGTTGYYYGMDV

SEQ ID NO: 37 - DNA, 15 bp, artificial
  2H12_LC#2 - CDR-H1
agctatggcatgcac

SEQ ID NO: 38 - DNA, 51 bp, artificial; identical to SEQ ID NO: 32
  2H12_LC#2 - CDR-H2

SEQ ID NO: 39 - DNA, 48 bp, artificial; identical to SEQ ID NO: 3
  2H12_LC#2 - CDR-H3

SEQ ID NO: 40 - protein, 5 aa, artificial
  2H12_LC#2 - CDR-H1
SYGMH

SEQ ID NO: 41 - protein, 17 aa, artificial
  2H12_LC#2 - CDR-H2
VIWYDGSNKYYTDSVKG

SEQ ID NO: 42 - protein, 16 aa, artificial
  2H12_LC#2 - CDR-H3
RAGIIGTTGYYYGMDV

SEQ ID NO: 43 - DNA, 21 bp, artificial
  4A2, 5B4, 5C5   - CDR-H1
agtagtggttactactggagc

SEQ ID NO: 44 - DNA, 48 bp, artificial
  4A2, 5B4, 5C5  - CDR-H2
tacatctattacactgggagcgcctactacaacccgtccctcaagagt

SEQ ID NO: 45 - DNA, 30 bp, artificial
  4A2, 5B4, 5C5  - CDR-H3
gatggaagcagtggctggtacttccagtat

SEQ ID NO: 46 - protein, 7 aa, artificial
  4A2, 5B4, 5C5  - CDR-H1
SSGYYWS

SEQ ID NO: 47 - protein, 16 aa, artificial
  4A2, 5B4, 5C5  - CDR-H2
YIYYTGSAYYNPSLKS

SEQ ID NO: 48 - protein, 10 aa, artificial
  4A2, 5B4, 5C5  - CDR-H3
DGSSGWYFQY

SEQ ID NO: 49 - DNA, 15 bp, artificial
  4A9 - CDR-H1
ggttactactggagc

SEQ ID NO: 50 - DNA, 48 bp, artificial
  4A9 - CDR-H2
tatttctcttacagtgggagcaccaactacaacccctccctcaagagt

SEQ ID NO: 51 - DNA, 24 bp, artificial
  4A9 - CDR-H3
aactgggccttccactttgacttc

SEQ ID NO: 52 - protein, 5 aa, artificial
  4A9 - CDR-H1
GYYWS

SEQ ID NO: 53 - protein, 16 aa, artificial
  4A9 - CDR-H2
YFSYSGSTNYNPSLKS

SEQ ID NO: 54 - protein, 8 aa, artificial
  4A9 - CDR-H3
NWAFHFDF

SEQ ID NO: 55 - DNA, 15 bp, artificial
  4B10, 4C2 - CDR-H1
agctatgacatgcac

SEQ ID NO: 56 - DNA, 51 bp, artificial
  4B10, 4C2  - CDR-H2
gttatatcatatgatggaactaatgaatactatgcagactccgtgaagggc

SEQ ID NO: 57 - DNA, 30 bp, artificial
  4B10, 4C2 - CDR-H3
gaacgatattttgactggtcttttgactac

SEQ ID NO: 58 - protein, 5 aa, artificial
  4B10, 4C2 - CDR-H1
SYDMH

SEQ ID NO: 59 - protein, 17 aa, artificial
  4B10, 4C2 - CDR-H2
VISYDGTNEYYADSVKG

SEQ ID NO: 60 - protein, 10 aa, artificial
  4B10, 4C2 - CDR-H3
ERYFDWSFDY

SEQ ID NO: 61 - DNA, 15 bp, artificial
  4D2 - CDR-H1
agttatgacatgcac

SEQ ID NO: 62 - DNA, 51 bp, artificial; identical to SEQ ID NO: 56
  4D2 - CDR-H2

SEQ ID NO: 63 - DNA, 30 bp, artificial; identical to SEQ ID NO: 57
  4D2 - CDR-H3

SEQ ID NO: 64 - protein, 5 aa, artificial
  4D2 - CDR-H1
SYDMH

SEQ ID NO: 65 - protein, 17 aa, artificial
  4D2 - CDR-H2
VISYDGTNEYYADSVKG

SEQ ID NO: 66 - protein, 10 aa, artificial
  4D2 - CDR-H3
ERYFDWSFDY

SEQ ID NO: 67 - DNA, 15 bp, artificial
  4D3, 4F3 - CDR-H1
agctatgacatggac

SEQ ID NO: 68 - DNA, 51 bp, artificial
  4D3, 4F3 - CDR-H2
gttatatggtatgatggaagtaataaatactatgcagactccgtgaggggc

SEQ ID NO: 69 - DNA, 30 bp, artificial
  4D3, 4F3 - CDR-H3
gaaactggggagggctggtacttcgatctc

SEQ ID NO: 70 - protein, 5 aa, artificial
  4D3, 4F3 - CDR-H1
SYDMD

SEQ ID NO: 71 - protein, 17 aa, artificial
  4D3, 4F3 - CDR-H2
VIWYDGSNKYYADSVRG

SEQ ID NO: 72 - protein, 10 aa, artificial
  4D3, 4F3 - CDR-H3
ETGEGWYFDL

SEQ ID NO: 73 - DNA, 15 bp, artificial
  4E10 - CDR-H1
agctatgacatgcac

SEQ ID NO: 74 - DNA, 51 bp, artificial; identical to SEQ ID NO: 2
  4E10 - CDR-H2

SEQ ID NO: 75 - DNA, 30 bp, artificial
  4E10 - CDR-H3
gagtataggtacagctggtactttgactac

SEQ ID NO: 76 - protein, 5 aa, artificial
  4E10 - CDR-H1
SYDMH

SEQ ID NO: 77 - protein, 17 aa, artificial
  4E10 - CDR-H2
VIWYDGSNKYYADSVKG

SEQ ID NO: 78 - protein, 10 aa, artificial
  4E10 - CDR-H3
EYRYSWYFDY

SEQ ID NO: 79 - DNA, 15 bp, artificial
  4F7 - CDR-H1
agttactcctggagc

SEQ ID NO: 80 - DNA, 48 bp, artificial
  4F7 - CDR-H2
tatatctattacagtgggagcaccaactacaacccctccctcaagagt

SEQ ID NO: 81 - DNA, 24 bp, artificial
  4F7 - CDR-H3
aactgggccttccactttgactac

SEQ ID NO: 82 - protein, 5 aa, artificial
  4F7 - CDR-H1
SYSWS

SEQ ID NO: 83 - protein, 16 aa, artificial
  4F7 - CDR-H2
YIYYSGSTNYNPSLKS

SEQ ID NO: 84 - protein, 8 aa, artificial
  4F7 - CDR-H3
NWAFHFDY

SEQ ID NO: 85 - DNA, 15 bp, artificial
  5E3 - CDR-H1
agctatagcatgcac

SEQ ID NO: 86 - DNA, 51 bp, artificial
  5E3 - CDR-H2
tccattagtagtagtagtagttacatatactacgcagactcagtgaagggc

SEQ ID NO: 87 - DNA, 42 bp, artificial
  5E3 - CDR-H3
ggggaaactggaactaactactactactacggtatggacgtc

SEQ ID NO: 88 - protein, 5 aa, artificial
  5E3 - CDR-H1
SYSMH

SEQ ID NO: 89 - protein, 17 aa, artificial
  5E3 - CDR-H2
SISSSSSYIYYADSVKG

SEQ ID NO: 90 - protein, 14 aa, artificial
  5E3 - CDR-H3
GETGTNYYYYGMDV

SEQ ID NO: 91 - DNA, 15 bp, artificial
  17H8, 23B6, 28D10 - CDR-H1
agttactactggagc

SEQ ID NO: 92 - DNA, 48 bp, artificial
  17H8, 23B6, 28D10 - CDR-H2
tatatctattacattgggagcaccaactacaacccctccctcaagagt

SEQ ID NO: 93 - DNA, 42 bp, artificial
  17H8, 23B6, 28D10 - CDR-H3
gattcccggtatagaagtggctggtacgatgcttttgatatc

SEQ ID NO: 94 - protein, 5 aa, artificial
  17H8, 23B6, 28D10 - CDR-H1
SYYWS

SEQ ID NO: 95 - protein, 16 aa, artificial
  17H8, 23B6, 28D10 - CDR-H2
YIYYIGSTNYNPSLKS

SEQ ID NO: 96 - protein, 14 aa, artificial
  17H8, 23B6, 28D10 - CDR-H3
DSRYRSGWYDAFDI

SEQ ID NO: 97 - DNA, 15 bp, artificial
  16C1 - CDR-H1
ggttactactggagc

SEQ ID NO: 98 - DNA, 48 bp, artificial; identical to SEQ ID NO: 92
  16C1 - CDR-H2

SEQ ID NO: 99 - DNA, 36 bp, artificial
  16C1 - CDR-H3
gatgggagcagtggctggtaccggtggttcgacccc

SEQ ID NO: 100 - protein, 5 aa, artificial
  16C1 - CDR-H1
GYYWS

SEQ ID NO: 101 - protein, 16 aa, artificial
  16C1 - CDR-H2
YIYYIGSTNYNPSLKS

SEQ ID NO: 102 - protein, 12 aa, artificial
  16C1 - CDR-H3
DGSSGWYRWFDP

SEQ ID NO: 103 - DNA, 15 bp, artificial
  16A4 - CDR-H1
agttactactggagc

SEQ ID NO: 104 - DNA, 48 bp, artificial
  16A4 - CDR-H2
tatatctattacagtgggagcaccaattacaacccctccctcaagagt

SEQ ID NO: 105 - DNA, 51 bp, artificial
  16A4 - CDR-H3
gatcaaaggcggatagcagcagctggtacccacttctacggtatggacgtc

SEQ ID NO: 106 - protein, 5 aa, artificial
  16A4 - CDR-H1
SYYWS

SEQ ID NO: 107 - protein, 16 aa, artificial
  16A4 - CDR-H2
YIYYSGSTNYNPSLKS

SEQ ID NO: 108 - protein, 17 aa, artificial
  16A4 - CDR-H3
DQRRIAAAGTHFYGMDV

SEQ ID NO: 109 - DNA, 15 bp, artificial
  16E2, 17E10, 20B12 - CDR-H1
agctatggcatgcac

SEQ ID NO: 110 - DNA, 51 bp, artificial
  16E2, 17E10, 20B12 - CDR-H2
gtgatatggtatgatggaagtaataaatactatgcagactccgtgaagggc

SEQ ID NO: 111 - DNA, 27 bp, artificial
  16E2, 17E10, 20B12 - CDR-H3
gacgggtgggagctgtcctttgactac

SEQ ID NO: 112 - protein, 5 aa, artificial
  16E2, 17E10, 20B12 - CDR-H1
SYGMH

SEQ ID NO: 113 - protein, 17 aa, artificial
  16E2, 17E10, 20B12 - CDR-H2
VIWYDGSNKYYADSVKG

SEQ ID NO: 114 - protein, 9 aa, artificial
  16E2, 17E10, 20B12 - CDR-H3
DGWELSFDY

SEQ ID NO: 115 - DNA, 15 bp, artificial
  22G10 - CDR-H1
agttatgccatgaac

SEQ ID NO: 116 - DNA, 51 bp, artificial
  22G10 - CDR-H2
actattagtggtggtggtgctaacacatactacgcagactccgtgaagggc

SEQ ID NO: 117 - DNA, 36 bp, artificial
  22G10 - CDR-H3
gggggaatggggggatactactacggtatggacgtc

SEQ ID NO: 118 - protein, 5 aa, artificial
  22G10 - CDR-H1
SYAMN

SEQ ID NO: 119 - protein, 17 aa, artificial
  22G10 - CDR-H2
TISGGGANTYYADSVKG

SEQ ID NO: 120 - protein, 12 aa, artificial
  22G10 - CDR-H3
GGMGGYYYGMDV

SEQ ID NO: 121 - DNA, 15 bp, artificial
  16H2, 20D3, 23E7  - CDR-H1
agctactttattcac

SEQ ID NO: 122 - DNA, 51 bp, artificial
  16H2, 20D3, 23E7  - CDR-H2
ataatcaaccctattagtgttagcacaagctacgcacagaagttccagggc

SEQ ID NO: 123 - DNA, 33 bp, artificial
  16H2, 20D3, 23E7  - CDR-H3
ggggggatacagctatggttacattttgactac

SEQ ID NO: 124 - protein, 5 aa, artificial
  16H2, 20D3, 23E7  - CDR-H1
SYFIH

SEQ ID NO: 125 - protein, 17 aa, artificial
  16H2, 20D3, 23E7  - CDR-H2
IINPISVSTSYAQKFQG

SEQ ID NO: 126 - protein, 11 aa, artificial
  16H2, 20D3, 23E7  - CDR-H3
GGIQLWLHFDY

SEQ ID NO: 127 - DNA, 15 bp, artificial
  22D1 - CDR-H1
agctactttattcac

SEQ ID NO: 128 - DNA, 51 bp, artificial; identical to SEQ ID NO: 122
  22D1 - CDR-H2

SEQ ID NO: 129 - DNA, 33 bp, artificial
  22D1 - CDR-H3
ggggggatacagctatggttacatttggactac

SEQ ID NO: 130 - protein, 5 aa, artificial
  22D1 - CDR-H1
SYFIH

SEQ ID NO: 131 - protein, 17 aa, artificial
  22D1 - CDR-H2
IINPISVSTSYAQKFQG

SEQ ID NO: 132 - protein, 11 aa, artificial
  22D1 - CDR-H3
GGIQLWLHLDY

SEQ ID NO: 133 - DNA, 15 bp, artificial
  25F8 - CDR-H1
agctactatattcac

SEQ ID NO: 134 - DNA, 51 bp, artificial
  25F8 - CDR-H2
ataatcaaccccagtggtggtagcacaaggtacgcacagaagttccagggc

SEQ ID NO: 135 - DNA, 33 bp, artificial
  25F8 - CDR-H3
gggggaatacagctatggttacattttgactac

SEQ ID NO: 136 - protein, 5 aa, artificial
  25F8 - CDR-H1
SYYIH

SEQ ID NO: 137 - protein, 17 aa, artificial
  25F8 - CDR-H2
IINPSGGSTRYAQKFQG

SEQ ID NO: 138 - protein, 11 aa, artificial
  25F8 - CDR-H3
GGIQLWLHFDY

SEQ ID NO: 139 - DNA, 15 bp, artificial
  26F12, 27B3 - CDR-H1
aactactatatgtcc

SEQ ID NO: 140 - DNA, 51 bp, artificial
  26F12, 27B3  - CDR-H2
ataatcaaccctagtggtggtgactcaacctacgcacagaagttccagggc

SEQ ID NO: 141 - DNA, 33 bp, artificial
  26F12, 27B3 - CDR-H3
ggggggatacaactatggttacattttgactac

SEQ ID NO: 142 - protein, 5 aa, artificial
  26F12, 27B3 - CDR-H1
NYYMS

SEQ ID NO: 143 - protein, 17 aa, artificial
  26F12, 27B3 - CDR-H2
IINPSGGDSTYAQKFQG

SEQ ID NO: 144 - protein, 11 aa, artificial
  26F12, 27B3 - CDR-H3
GGIQLWLHFDY

SEQ ID NO: 145 - DNA, 15 bp, artificial
  26D1 - CDR-H1
agctactatatgtcc

SEQ ID NO: 146 - DNA, 51 bp, artificial
  26D1 - CDR-H2
ataatccaccctagtggtggtgacacaacctacgcacagaagttccagggc

SEQ ID NO: 147 - DNA, 33 bp, artificial
  26D1 - CDR-H3
ggggggataaaactatggttacattttgactat

SEQ ID NO: 148 - protein, 5 aa, artificial
  26D1 - CDR-H1
SYYMS

SEQ ID NO: 149 - protein, 17 aa, artificial
  26D1 - CDR-H2
IIHPSGGDTTYAQKFQG

SEQ ID NO: 150 - protein, 11 aa, artificial
  26D1 - CDR-H3
GGIKLWLHFDY

SEQ ID NO: 151 - DNA, 15 bp, artificial
  25G10 - CDR-H1
ggttactactggagc

SEQ ID NO: 152 - DNA, 48 bp, artificial; identical to SEQ ID NO: 92
  25G10  CDR-H2

SEQ ID NO: 153 - DNA, 36 bp, artificial; identical to SEQ ID NO: 99
  25G10 - CDR-H3

SEQ ID NO: 154 - protein, 5 aa, artificial
  25G10 - CDR-H1
GYYWS

SEQ ID NO: 155 - protein, 16 aa, artificial
  25G10 - CDR-H2
YIYYIGSTNYNPSLKS

SEQ ID NO: 156 - protein, 12 aa, artificial
  25G10 - CDR-H3
DGSSGWYRWFDP

SEQ ID NO: 157 - DNA, 15 bp, artificial
  23A10 - CDR-H1
cgctatggcatacac

SEQ ID NO: 158 - DNA, 51 bp, artificial; identical to SEQ ID NO: 2
  23A10 - CDR-H2

SEQ ID NO: 159 - DNA, 48 bp, artificial
  23A10 - CDR-H3
agggccggtatacctggaactacgggctactactatggtatggacgtc

SEQ ID NO: 160 - protein, 5 aa, artificial
  23A10 - CDR-H1
RYGIH

SEQ ID NO: 161 - protein, 17 aa, artificial
  23A10 - CDR-H2
VIWYDGSNKYYADSVKG

SEQ ID NO: 162 - protein, 16 aa, artificial
  23A10 - CDR-H3
RAGIPGTTGYYYGMDV

SEQ ID NO: 163 - DNA, 15 bp, artificial
  19B5 - CDR-H1
agctactttattcac

SEQ ID NO: 164 - DNA, 51 bp, artificial
  19B5 - CDR-H2
attatcaaccctattagtgttagcacaagctacgcacagaagttccagggc

SEQ ID NO: 165 - DNA, 33 bp, artificial; identical to SEQ ID NO: 129
  19B5 - CDR-H3

SEQ ID NO: 166 - protein, 5 aa, artificial
  19B5 - CDR-H1
SYFIH

SEQ ID NO: 167 - protein, 17 aa, artificial
  19B5 - CDR-H2
IINPISVSTSYAQKFQG

SEQ ID NO: 168 - protein, 11 aa, artificial
  19B5 - CDR-H3
GGIQLWLHLDY

SEQ ID NO: 169 - DNA, 33 bp, artificial
  1D10, 2C12  - CDR-L1
tctggagatagattgggggaaaaatatacttgc

SEQ ID NO: 170 - DNA, 21 bp, artificial
  1D10, 2C12 - CDR-L2
caagataccaagcggccctca

SEQ ID NO: 171 - DNA, 27 bp, artificial
  1D10, 2C12 - CDR-L3
caggcgtgggacagcagcactgtggta

SEQ ID NO: 172 - protein, 11 aa, artificial
  1D10, 2C12 - CDR-L1
SGDRLGEKYTC

SEQ ID NO: 173 - protein, 7 aa, artificial
  1D10, 2C12 - CDR-L2
QDTKRPS

SEQ ID NO: 174 - protein, 9 aa, artificial
  1D10, 2C12 - CDR-L3
QAWDSSTVV

SEQ ID NO: 175 - DNA, 36 bp, artificial
  1F10 - CDR-L1
agggccagtcggagtattagcagcagctacttagcc

SEQ ID NO: 176 - DNA, 21 bp, artificial
  1F10 - CDR-L2
ggtccatccagcagggccact

SEQ ID NO: 177 - DNA, 24 bp, artificial
  1F10 - CDR-L3
cagcagtatggtagctcattcact

SEQ ID NO: 178 - protein, 12 aa, artificial
  1F10 - CDR-L1
RASRSISSSYLA

SEQ ID NO: 179 - protein, 7 aa, artificial
  1F10 - CDR-L2
GPSSRAT

SEQ ID NO: 180 - protein, 8 aa, artificial
  1F10 - CDR-L3
QQYGSSFT

SEQ ID NO: 181 - DNA, 48 bp, artificial
  2C12_LC#1 - CDR-L1
aggtctagtcaaagcctcgtatacagtgatggaaacacctacttgaat

SEQ ID NO: 182 - DNA, 21 bp, artificial
  2C12_LC#1 - CDR-L2
aaggtttctaactgggactct

SEQ ID NO: 183 - DNA, 27 bp, artificial
  2C12_LC#1 - CDR-L3
atgcaaggtatagtgtggccgtgcagt

SEQ ID NO: 184 - protein, 16 aa, artificial
  2C12_LC#1 - CDR-L1
RSSQSLVYSDGNTYLN

SEQ ID NO: 185 - protein, 7 aa, artificial
  2C12_LC#1 - CDR-L2
KVSNWDS

SEQ ID NO: 186 - protein, 9 aa, artificial
  2C12_LC#1 - CDR-L3
MQGIVWPCS

SEQ ID NO: 187 - DNA, 48 bp, artificial; identical to SEQ ID NO: 181
  2G6_LC#1 - CDR-L1

SEQ ID NO: 188 - DNA, 21 bp, artificial
  2G6_LC#1 - CDR-L2
caggtttctaactgggactct

SEQ ID NO: 189 - DNA, 27 bp, artificial
  2G6_LC#1 - CDR-L3
atgcaagatacactgtggccgtgcagt

SEQ ID NO: 190 - protein, 16 aa, artificial
  2G6_LC#1 - CDR-L1
RSSQSLVYSDGNTYLN

SEQ ID NO: 191 - protein, 7 aa, artificial
  2G6_LC#1 - CDR-L2
QVSNWDS

SEQ ID NO: 192 - protein, 9 aa, artificial
  2G6_LC#1 - CDR-L3
MQDTLWPCS

SEQ ID NO: 193 - DNA, 33 bp, artificial
  2G6 - CDR-L1
tctggagataggttgggggaaaaatatacttgc

SEQ ID NO: 194 - DNA, 21 bp, artificial
  2G6 - CDR-L2
caagataccaagcggccctca

SEQ ID NO: 195 - DNA, 27 bp, artificial
  2G6 - CDR-L3
caggcgtgggacagcagcactgtggta

SEQ ID NO: 196 - protein, 11 aa, artificial
  2G6 - CDR-L1
SGDRLGEKYTC

SEQ ID NO: 197 - protein, 7 aa, artificial
  2G6 - CDR-L2
QDTKRPS

SEQ ID NO: 198 - protein, 9 aa, artificial
  2G6 - CDR-L3
QAWDSSTVV

SEQ ID NO: 199 - DNA, 33 bp, artificial; identical to SEQ ID NO: 169
  2H12 - CDR-L1

SEQ ID NO: 200 - DNA, 21 bp, artificial
  2H12 - CDR-L2
caagataccaagcggccctca

SEQ ID NO: 201 - DNA, 27 bp, artificial
  2H12 - CDR-L3
caggcgtgggacagcagcactgtggta

SEQ ID NO: 202 - protein, 11 aa, artificial
  2H12 - CDR-L1
SGDRLGEKYTC

SEQ ID NO: 203 - protein, 7 aa, artificial
  2H12 - CDR-L2
QDTKRPS

SEQ ID NO: 204 - protein, 9 aa, artificial
  2H12 - CDR-L3
QAWDSSTVV

SEQ ID NO: 205 - DNA, 48 bp, artificial; identical to SEQ ID NO: 181
  2H12_LC#2 - CDR-L1

SEQ ID NO: 206 - DNA, 21 bp, artificial
  2H12_LC#2 - CDR-L2
aaggtttctaactgggactct

SEQ ID NO: 207 - DNA, 27 bp, artificial
  2H12_LC#2 - CDR-L3
atgcaagatacactgtggccgtgcagt

SEQ ID NO: 208 - protein, 16 aa, artificial
  2H12_LC#2 - CDR-L1
RSSQSLVYSDGNTYLN

SEQ ID NO: 209 - protein, 7 aa, artificial
  2H12_LC#2 - CDR-L2
KVSNWDS

SEQ ID NO: 210 - protein, 9 aa, artificial
  2H12_LC#2 - CDR-L3
MQDTLWPCS

SEQ ID NO: 211 - DNA, 36 bp, artificial
  4A2, 5B4, 5C5  - CDR-L1
agggccagtcggaatattagcagcagctacttagcc

SEQ ID NO: 212 - DNA, 21 bp, artificial
  4A2, 5B4, 5C5  - CDR-L2
ggtccatccagcagggccact

SEQ ID NO: 213 - DNA, 24 bp, artificial
  4A2, 5B4, 5C5  - CDR-L3
cagcagtatggtagctcattcact

SEQ ID NO: 214 - protein, 12 aa, artificial
  4A2, 5B4, 5C5  - CDR-L1
RASRNISSSYLA

SEQ ID NO: 215 - protein, 7 aa, artificial
  4A2, 5B4, 5C5  - CDR-L2
GPSSRAT

SEQ ID NO: 216 - protein, 8 aa, artificial
  4A2, 5B4, 5C5  - CDR-L3
QQYGSSFT

SEQ ID NO: 217 - DNA, 42 bp, artificial
  4A9 - CDR-L1
actgggagcagctccaacatcgggacaggttatgctgtacac

SEQ ID NO: 218 - DNA, 21 bp, artificial
  4A9 - CDR-L2
ggtaacaacaatcggccctca

SEQ ID NO: 219 - DNA, 33 bp, artificial
  4A9 - CDR-L3
cagtcctatgacagcagactgagtggttgggtg

SEQ ID NO: 220 - protein, 14 aa, artificial
  4A9 - CDR-L1
TGSSSNIGTGYAVH

SEQ ID NO: 221 - protein, 7 aa, artificial
  4A9 - CDR-L2
GNNNRPS

SEQ ID NO: 222 - protein, 11 aa, artificial
  4A9 - CDR-L3
QSYDSRLSGWV

SEQ ID NO: 223 - DNA, 36 bp, artificial
  4B10, 4C2 - CDR-L1
agggccagtcagagtgttagcaacacctacttagcc

SEQ ID NO: 224 - DNA, 21 bp, artificial
  4B10, 4C2 - CDR-L2
ggtgcatccagcagggccact

SEQ ID NO: 225 - DNA, 24 bp, artificial
  4B10, 4C2 - CDR-L3
cagcagtacagtaactcgtggacg

SEQ ID NO: 226 - protein, 12 aa, artificial
  4B10, 4C2 - CDR-L1
RASQSVSNTYLA

SEQ ID NO: 227 - protein, 7 aa, artificial
  4B10, 4C2 - CDR-L2
GASSRAT

SEQ ID NO: 228 - protein, 8 aa, artificial
  4B10, 4C2 - CDR-L3
QQYSNSWT

SEQ ID NO: 229 - DNA, 36 bp, artificial; identical to SEQ ID NO: 223
  4D2 - CDR-L1

SEQ ID NO: 230 - DNA, 21 bp, artificial
  4D2 - CDR-L2
ggtgcatccagcagggccgct

SEQ ID NO: 231 - DNA, 24 bp, artificial
  4D2 - CDR-L3
cagcagtatagtaactcgtggacg

SEQ ID NO: 232 - protein, 12 aa, artificial
  4D2 - CDR-L1
RASQSVSNTYLA

SEQ ID NO: 233 - protein, 7 aa, artificial
  4D2 - CDR-L2
GASSRAA

SEQ ID NO: 234 - protein, 8 aa, artificial
  4D2 - CDR-L3
QQYSNSWT

SEQ ID NO: 235 - DNA, 36 bp, artificial
  4D3, 4F3 - CDR-L1
agggccagtcagagtgttagcagcagctacttagcc

SEQ ID NO: 236 - DNA, 21 bp, artificial
  4D3, 4F3 - CDR-L2
ggtgcatccagcagggccact

SEQ ID NO: 237 - DNA, 24 bp, artificial
  4D3, 4F3 - CDR-L3
cagcagtatggtagctcgtggacg

SEQ ID NO: 238 - protein, 12 aa, artificial
  4D3, 4F3 - CDR-L1
RASQSVSSSYLA

SEQ ID NO: 239 - protein, 7 aa, artificial
  4D3, 4F3 - CDR-L2
GASSRAT

SEQ ID NO: 240 - protein, 8 aa, artificial
  4D3, 4F3 - CDR-L3
QQYGSSWT

SEQ ID NO: 241 - DNA, 36 bp, artificial
  4E10 - CDR-L1
agggccagtcagagtgttggcagcagctacttagcc

SEQ ID NO: 242 - DNA, 21 bp, artificial
  4E10 - CDR-L2
ggtgcatccagcagggtcact

SEQ ID NO: 243 - DNA, 24 bp, artificial
  4E10 - CDR-L3
cagcaatatagtaactcgtggacg

SEQ ID NO: 244 - protein, 12 aa, artificial
  4E10 - CDR-L1
RASQSVGSSYLA

SEQ ID NO: 245 - protein, 7 aa, artificial
  4E10 - CDR-L2
GASSRVT

SEQ ID NO: 246 - protein, 8 aa, artificial
  4E10 - CDR-L3
QQYSNSWT

SEQ ID NO: 247 - DNA, 42 bp, artificial
  4F7 - CDR-L1
actgggagcagctccaatatcgggacaggttatgatgtacac

SEQ ID NO: 248 - DNA, 21 bp, artificial
  4F7 - CDR-L2
ggtaacagcaatcggccctca

SEQ ID NO: 249 - protein, 33 aa, artificial
  4F7 - CDR-L3
CAGTCCTATGACAGCAGTCTGAGTGGTTGGGTG

SEQ ID NO: 250 - protein, 14 aa, artificial
  4F7 - CDR-L1
TGSSSNIGTGYDVH

SEQ ID NO: 251 - protein, 7 aa, artificial
  4F7 - CDR-L2
GNSNRPS

SEQ ID NO: 252 - protein, 11 aa, artificial
  4F7 - CDR-L3
QSYDSSLSGWV

SEQ ID NO: 253 - DNA, 33 bp, artificial
  5E3 - CDR-L1
tctggagataaattgggggatgaatatgcttgc

SEQ ID NO: 254 - DNA, 21 bp, artificial
  5E3 - CDR-L2
caagatagcaagcggccctca

SEQ ID NO: 255 - DNA, 27 bp, artificial
  5E3 - CDR-L3
caggcgtgggacagcagcactgtggta

SEQ ID NO: 256 - protein, 11 aa, artificial
  5E3 - CDR-L1
SGDKLGDEYAC

SEQ ID NO: 257 - protein, 7 aa, artificial
  5E3 - CDR-L2
QDSKRPS

SEQ ID NO: 258 - protein, 9 aa, artificial
  5E3 - CDR-L3
QAWDSSTVV

SEQ ID NO: 259 - DNA, 36 bp, artificial
  17H8, 23B6, 28D10 - CDR-L1
agggccagtcagagtgttgccggcagctacctagcc

SEQ ID NO: 260 - DNA, 21 bp, artificial
  17H8, 23B6, 28D10 - CDR-L2
ggtgcatccagcagggccact

SEQ ID NO: 261 - DNA, 27 bp, artificial
  17H8, 23B6, 28D10 - CDR-L3
cagcagtatggtaaatcaccgatcacc

SEQ ID NO: 262 - protein, 12 aa, artificial
  17H8, 23B6, 28D10 - CDR-L1
RASQSVAGSYLA

SEQ ID NO: 263 - protein, 7 aa, artificial
  17H8, 23B6, 28D10 - CDR-L2
GASSRAT

SEQ ID NO: 264 - protein, 9 aa, artificial
  17H8, 23B6, 28D10 - CDR-L3
QQYGKSPIT

SEQ ID NO: 265 - DNA, 36 bp, artificial
  16C1 - CDR-L1
agggccagccagagtgttagcagcagctacttagcc

SEQ ID NO: 266 - DNA, 21 bp, artificial
  16C1 - CDR-L2
ggtgcatccagcagggccact

SEQ ID NO: 267 - DNA, 27 bp, artificial
  16C1 - CDR-L3
cagcagtatggtaactcaccgctcact

SEQ ID NO: 268 - protein, 12 aa, artificial
  16C1 - CDR-L1
RASQSVSSSYLA

SEQ ID NO: 269 - protein, 7 aa, artificial
  16C1 - CDR-L2
GASSRAT

SEQ ID NO: 270 - protein, 9 aa, artificial
  16C1 - CDR-L3
QQYGNSPLT

SEQ ID NO: 271 - DNA, 36 bp, artificial
  16A4 - CDR-L1
agggccagtcagagtgttagcagcagttatttagcc

SEQ ID NO: 272 - DNA, 21 bp, artificial
  16A4 - CDR-L2
ggtacatccagcagggccact

SEQ ID NO: 273 - DNA, 27 bp, artificial
  16A4 - CDR-L3
cagcagtacggtagctcacctttcact

SEQ ID NO: 274 - protein, 12 aa, artificial
  16A4 - CDR-L1
RASQSVSSSYLA

SEQ ID NO: 275 - protein, 7 aa, artificial
  16A4 - CDR-L2
GTSSRAT

SEQ ID NO: 276 - protein, 9 aa, artificial
  16A4 - CDR-L3
QQYGSSPFT

SEQ ID NO: 277 - DNA, 33 bp, artificial
  16E2, 17E10, 20B12  - CDR-L1
cgggcgagtcagggcattagcaattatttagcc

SEQ ID NO: 278 - DNA, 21 bp, artificial
  16E2, 17E10, 20B12  - CDR-L2
gctgcatccagtttgcaaagt

SEQ ID NO: 279 - DNA, 27 bp, artificial
  16E2, 17E10, 20B12  - CDR-L3
caacactattttacttaccctcggacg

SEQ ID NO: 280 - protein, 11 aa, artificial
  16E2, 17E10, 20B12  - CDR-L1
RASQGISNYLA

SEQ ID NO: 281 - protein, 7 aa, artificial
  16E2, 17E10, 20B12  - CDR-L2
AASSLQS

SEQ ID NO: 282 - protein, 9 aa, artificial
  16E2, 17E10, 20B12  - CDR-L3
QHYFTYPRT

SEQ ID NO: 283 - DNA, 33 bp, artificial
  22G10 - CDR-L1
agggccagtcagagtattagcagcaacttagcc

SEQ ID NO: 284 - DNA, 21 bp, artificial
  22G10 - CDR-L2
ggtgcatttaccagggccact

SEQ ID NO: 285 - DNA, 27 bp, artificial
  22G10 - CDR-L3
cagcagtataattactggccgctcact

SEQ ID NO: 286 - protein, 11 aa, artificial
  22G10 - CDR-L1
RASQSISSNLA

SEQ ID NO: 287 - protein, 7 aa, artificial
  22G10 - CDR-L2
GAFTRAT

SEQ ID NO: 288 - protein, 9 aa, artificial
  22G10 - CDR-L3
QQYNYWPLT

SEQ ID NO: 289 - DNA, 39 bp, artificial
  16H2, 20D3, 23E7 - CDR-L1
tctggaagcagctccaacatcggaagtaattttgtaaac

SEQ ID NO: 290 - DNA, 21 bp, artificial
  16H2, 20D3, 23E7 - CDR-L2
actaataatcagcggccctca

SEQ ID NO: 291 - DNA, 33 bp, artificial
  16H2, 20D3, 23E7 - CDR-L3
gcaacatgggatgacagcctgaatggttgggtg

SEQ ID NO: 292 - protein, 13 aa, artificial
  16H2, 20D3, 23E7 - CDR-L1
SGSSSNIGSNFVN

SEQ ID NO: 293 - protein, 7 aa, artificial
  16H2, 20D3, 23E7 - CDR-L2
TNNQRPS

SEQ ID NO: 294 - protein, 11 aa, artificial
  16H2, 20D3, 23E7 - CDR-L3
ATWDDSLNGWV

SEQ ID NO: 295 - DNA, 39 bp, artificial
  22D1 - CDR-L1
tctggaagcagctccaacatcggaagcaattttgtaaac

SEQ ID NO: 296 - DNA, 21 bp, artificial
  22D1 - CDR-L2
actaataatcagcggccctca

SEQ ID NO: 297 - DNA, 33 bp, artificial
  22D1 - CDR-L3
gcaacatgggatgacagtatgaatggttgggtg

SEQ ID NO: 298 - protein, 13 aa, artificial
  22D1 - CDR-L1
SGSSSNIGSNFVN

SEQ ID NO: 299 - protein, 7 aa, artificial
  22D1 - CDR-L2
TNNQRPS

SEQ ID NO: 300 - protein, 11 aa, artificial
  22D1 - CDR-L3
ATWDDSMNGWV

SEQ ID NO: 301 - DNA, 39 bp, artificial
  25F8 - CDR-L1
tctggaagcagctccaacatcggaaggaattttgtaaac

SEQ ID NO: 302 - DNA, 21 bp, artificial
  25F8 - CDR-L2
actaataatcagcggccctca

SEQ ID NO: 303 - DNA, 33 bp, artificial
  25F8 - CDR-L3
gcagcatgggatgacagcctgaatggttgggtg

SEQ ID NO: 304 - protein, 13 aa, artificial
  25F8 - CDR-L1
SGSSSNIGRNFVN

SEQ ID NO: 305 - protein, 7 aa, artificial
  25F8 - CDR-L2
TNNQRPS

SEQ ID NO: 306 - protein, 11 aa, artificial
  25F8 - CDR-L3
AAWDDSLNGWV

SEQ ID NO: 307 - DNA, 39 bp, artificial
  26F12, 27B3 - CDR-L1
tctggaagccgctccaacatcggaagtaattttgtaaac

SEQ ID NO: 308 - DNA, 21 bp, artificial
  26F12, 27B3 - CDR-L2
actaattatcagcggccctca

SEQ ID NO: 309 - DNA, 33 bp, artificial
  26F12, 27B3 - CDR-L3
gcagtatgggatgacagcctgaatggttgggtg

SEQ ID NO: 310 - protein, 13 aa, artificial
  26F12, 27B3 - CDR-L1
SGSRSNIGSNFVN

SEQ ID NO: 311 - protein, 7 aa, artificial
  26F12, 27B3 - CDR-L2
TNYQRPS

SEQ ID NO: 312 - protein, 11 aa, artificial
  26F12, 27B3 - CDR-L3
AVWDDSLNGWV

SEQ ID NO: 313 - DNA, 39 bp, artificial; identical to SEQ ID NO: 307
  26D1 - CDR-L1

SEQ ID NO: 314 - DNA, 21 bp, artificial
  26D1 - CDR-L2
actaataatcagcggccctca

SEQ ID NO: 315 - DNA, 33 bp, artificial; identical to SEQ ID NO: 309
  26D1 - CDR-L3

SEQ ID NO: 316 - protein, 13 aa, artificial
  26D1 - CDR-L1
SGSRSNIGSNFVN

SEQ ID NO: 317 - protein, 7 aa, artificial
  26D1 - CDR-L2
TNNQRPS

SEQ ID NO: 318 - protein, 11 aa, artificial
  26D1 - CDR-L3
AVWDDSLNGWV

SEQ ID NO: 319 - DNA, 36 bp, artificial; identical to SEQ ID NO: 235
  25G10 - CDR-L1

SEQ ID NO: 320 - DNA, 21 bp, artificial
  25G10 - CDR-L2
ggtgcatccagcagggccact

SEQ ID NO: 321 - DNA, 27 bp, artificial
  25G10 - CDR-L3
cagcagtatggtaactcaccgctcact

SEQ ID NO: 322 - protein, 12 aa, artificial
  25G10 - CDR-L1
RASQSVSSSYLA

SEQ ID NO: 323 - protein, 7 aa, artificial
  25G10 - CDR-L2
GASSRAT

SEQ ID NO: 324 - protein, 9 aa, artificial
  25G10 - CDR-L3
QQYGNSPLT

SEQ ID NO: 325 - DNA, 33 bp, artificial
  23A10 - CDR-L1
tctggagatagattgggggagaaatatgtttgc

SEQ ID NO: 326 - DNA, 21 bp, artificial
  23A10 - CDR-L2
caagataataagtggccctca

SEQ ID NO: 327 - DNA, 27 bp, artificial
  23A10 - CDR-L3
caggcgtgggacagcagcactgtggta

SEQ ID NO: 328 - protein, 11 aa, artificial
  23A10 - CDR-L1
SGDRLGEKYVC

SEQ ID NO: 329 - protein, 7 aa, artificial
  23A10 - CDR-L2
QDNKWPS

SEQ ID NO: 330 - protein, 9 aa, artificial
  23A10 - CDR-L3
QAWDSSTVV

SEQ ID NO: 331 - DNA, 39 bp, artificial
  19B5 - CDR-L1
tctggaagcaggtccaacatcggaagcaattttgtaaac

SEQ ID NO: 332 - DNA, 21 bp, artificial
  19B5 - CDR-L2
actaataatcagcggccctca

SEQ ID NO: 333 - DNA, 33 bp, artificial; identical to SEQ ID NO: 297
  19B5 - CDR-L3

SEQ ID NO: 334 - protein, 13 aa, artificial
  19B5 - CDR-L1
SGSRSNIGSNFVN

SEQ ID NO: 335 - protein, 7 aa, artificial
  19B5 - CDR-L2
TNNQRPS

SEQ ID NO: 336 - protein, 11 aa, artificial
  19B5 - CDR-L3
ATWDDSMNGWV

SEQ ID NO: 337 - DNA, 366 bp, artificial
  17H8, 23B6, 28D10 - HCVR
caggtgcagctgcaggagtcgggcccaggactggtgaagccttcggagaccctgtccctcacgtgcactgtctctggtggctccatcaatagttactactggagctggatccggcagcccccagggaagggactggagtggattgggtatatctattacattgggagcaccaactacaacccctccctcaagagtcgcgtcaccatatcagtagacacgtccaagaaccagttctccctgaagctgagctctgtgaccgctgcggacacggccctgtattactgtgcgagagattcccggtatagaagtggctggtacgatgcttttgatatctggggccaagggacaatggtcaccgtctcttca

SEQ ID NO: 338 - protein, 122 aa, artificial
  17H8, 23B6, 28D10 - HCVR
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSS

SEQ ID NO: 339 - DNA, 360 bp, artificial
  4A2, 5B4, 5C5  - HCVR
caggtgcagctgcaggagtcgggcccaggactggtgaagccttcacagaccctgtccctcacctgcactgtctctggtggctccatcagcagtagtggttactactggagctggatccgccagcacccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctcctca

SEQ ID NO: 340 - protein, 120 aa, artificial
  4A2, 5B4, 5C5  - HCVR
QVQLQESGPGLVKPSQTLSLTCTVSGGSISSSGYYWSWIRQHPGKGLEWIGYIYYTGSAYYNPSLKSRVTISVDTSKNQFSLKLSSVTAADTAVYYCARDGSSGWYFQYWGQGTLVTVSS

SEQ ID NO: 341 - DNA, 360 bp, artificial
  16H2, 20D3, 23E7  - HCVR
caggtgcagctggtgcagtctggggctgaggtgaagaagcctggggcctcagtgaaggtttcctgcaaggtttctggatacaccttcaccagctactttattcactgggtgcgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacattttgactactggggccagggaaccctggtcaccgtctcctca

SEQ ID NO: 342 - protein, 120 aa, artificial
  16H2, 20D3, 23E7  - HCVR
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSS

SEQ ID NO: 343 - DNA, 360 bp, artificial
  26F12, 27B3 - HCVR
caggtgcagttggtgcagtctggggctgaggtgaagaagcctggggcctcagtgaaggtttcctgcaaggcatctagatacaccttcaccaactactatatgtcctgggtgcgacaggcccctggacaagggcttgagtggatgggaataatcaaccctagtggtggtgactcaacctacgcacagaagttccagggcagactcaccatgaccggggacacgtccacgagcacagtctacatggagctgagcagcctgagatctgaggacacggccgtgtattactgtgcgagaggggggatacaactatggttacattttgactactggggccagggaaccctggtcaccgtctcctca

SEQ ID NO: 344 - protein, 120 aa, artificial
  26F12, 27B3 - HCVR
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSS

SEQ ID NO: 345 - DNA, 357 bp, artificial
  4B10, 4C2 - HCVR
caggtgcagttggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagtgtctcctca

SEQ ID NO: 346 - protein, 119 aa, artificial
  4B10, 4C2 - HCVR
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 347 - DNA, 357 bp, artificial
  4D3, 4F3 - HCVR
caggtgcagctggtggagtctgggggaggcgtggtccagcctgggaggtccctgagactctcctgtgcagcgtctggattctccttcagtagctatgacatggactgggtccgccagactccaggcaaggggctggagtgggtggcagttatatggtatgatggaagtaataaatactatgcagactccgtgaggggccgattcaccatctccagagacaattccaagaacacgctgtttctgcaaatgaacagcctgagagtcgaggacacggctgtgtattactgtgcgagagaaactggggagggctggtacttcgatctctggggccgtggcaccctggtcactgtctcctca

SEQ ID NO: 348 - protein, 119 aa, artificial
  4D3, 4F3 - HCVR
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSS

SEQ ID NO: 349 - DNA, 354 bp, artificial
  16E2, 17E10, 20B12  - HCVR
caggtgcagctggtggagtctgggggaggcgtggtccagcctgggaggtccctgagactctcctgtgcagcgtctggattcatcttcagtagctatggcatgcactgggtccgccagactccaggcaaggggctggagtgggtggcagtgatatggtatgatggaagtaataaatactatgcagactccgtgaagggccgattcaccatctccagagacatttccaagaacacgctgtatctgcaaatgaacagcctgagagtcgaggacacggctgtgtattactgtgcgagagacgggtgggagctgtcctttgactactggggccagggaaccctggtcaccgtctcctca

SEQ ID NO: 350 - protein, 118 aa, artificial
  16E2, 17E10, 20B12  - HCVR
QVQLVESGGGVVQPGRSLRLSCAASGFIFSSYGMHWVRQTPGKGLEWVAVIWYDGSNKYYADSVKGRFTISRDISKNTLYLQMNSLRVEDTAVYYCARDGWELSFDYWGQGTLVTVSS

SEQ ID NO: 351 - DNA, 375 bp, artificial
  1D10, 2C12 - HCVR
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtgtcagttatatggtatgatggaagtaataaatactatgcagactccgtgaagggccgattcaccatctccagagacaattccaagaacacgctgtatctgcaaatgaatagcctgagagctgaggacacggctgtgtattactgcgcgagaagggccggtataataggaactacaggctactactacggtatggacgtctggggccaagggaccacggtcaccgtctcctca

SEQ ID NO: 352 - protein, 125 aa, artificial
  1D10, 2C12 - HCVR
QVQLVESGGGVVQPGRSLRLSCAASGFTFSSYGMHWVRQAPGKGLEWVSVIWYDGSNKYYADSVKGRFTISRDNSKNTLYLQMNSLRAEDTAVYYCARRAGIIGTTGYYYGMDVWGQGTTVTVSS

SEQ ID NO: 353 - DNA, 360 bp, artificial
  16C1 - HCVR
caggtgcagctgcaggagtcgggcccaggactggtgaagccttcggagaccctgtccctcacttgtactgtctctggtggctccatcagtggttactactggagctggatccggcagcccccagggaagggactggagtggattgggtatatctattacattgggagcaccaactacaacccctccctcaagagtcgagtcaccatgtcaatagacacgtccaagaaccagttctccctgacgctgagctctttgaccgctgcggacacggccgtgtatttctgtgcgagagatgggagcagtggctggtaccggtggttcgacccctggggccagggaaccctggtcaccgtctcctca

SEQ ID NO: 354 - protein, 120 aa, artificial
  16C1 - HCVR
QVQLQESGPGLVKPSETLSLTCTVSGGSISGYYWSWIRQPPGKGLEWIGYIYYIGSTNYNPSLKSRVTMSIDTSKNQFSLTLSSLTAADTAVYFCARDGSSGWYRWFDPWGQGTLVTVSS

SEQ ID NO: 355 - DNA, 360 bp, artificial
  25G10 - HCVR
caggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacattgggagcaccaactacaacccctccctcaagagtcgagtcaccatgtcagtagacacgtccaagaaccagttctccctgaagctgagctctgtgaccgctgcggacacggccgtgtattactgtgcgagagatgggagcagtggctggtaccggtggttcgacccctggggccagggaaccctggtcaccgtctcctca

SEQ ID NO: 356 - protein, 360 aa, artificial
  25G10 - HCVR
CAGGTGCAGCTGCAGGAGTCGGGCCCAGGACTGGTGAAGCCTTCGGAGACCCTGTCCCTCACCTGCACTGTCTCTGGTGGCTCCATCAGTGGTTACTACTGGAGCTGGATCCGGCAGCCCCCAGGGAAGGGACTGGAGTGGATTGGGTATATCTATTACATTGGGAGCACCAACTACAACCCCTCCCTCAAGAGTCGAGTCACCATGTCAGTAGACACGTCCAAGAACCAGTTCTCCCTGAAGCTGAGCTCTGTGACCGCTGCGGACACGGCCGTGTATTACTGTGCGAGAGATGGGAGCAGTGGCTGGTACCGGTGGTTCGACCCCTGGGGCCAGGGAACCCTGGTCACCGTCTCCTCA

SEQ ID NO: 357 - DNA, 375 bp, artificial
  16A4 - HCVR
caggtgcagctgcaggagtcgggcccaggactggcgaagccttcggagaccctgtccctcacctgcactgtctctggtgactccatcactagttactactggagctggatccggcagcccccagggaagggactggagtggattgggtatatctattacagtgggagcaccaattacaacccctccctcaagagtcgagtcaccatatcagtagacacgtccaagaaccagttctccctgaagctgagttctgtgaccgctgcggacacggccgtgtattactgtgcgagagatcaaaggcggatagcagcagctggtacccacttctacggtatggacgtctggggccaagggaccacggtcaccgtctcctca

SEQ ID NO: 358 - protein, 125 aa, artificial
  16A4 - HCVR
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSS

SEQ ID NO: 359 - DNA, 360 bp, artificial
  1F10 - HCVR
caggtgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcacgagtcgagttaccatatcagtagacacgtctaagaaccagttctccctgaagctgagctctgtgactgccgcggacacggccgtgtattactgtgcgagagatggaagcagtggctggtacttccagcactggggccagggcaccctggtcaccgtctcctca

SEQ ID NO: 360 - protein, 120 aa, artificial
  1F10 - HCVR
QVQLQESGPGLVKPSQTLSLTCTVSGGSISSGGYYWSWIRQHPGKGLEWIGYIYYSGSTYYNPSLTSRVTISVDTSKNQFSLKLSSVTAADTAVYYCARDGSSGWYFQHWGQGTLVTVSS

SEQ ID NO: 361 - DNA, 348 bp, artificial
  4A9 - HCVR
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctcctca

SEQ ID NO: 362 - protein, 116 aa, artificial
  4A9 - HCVR
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSS

SEQ ID NO: 363 - DNA, 348 bp, artificial
  4F7 - HCVR
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctcctca

SEQ ID NO: 364 - protein, 116 aa, artificial
  4F7 - HCVR
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSS

SEQ ID NO: 365 - DNA, 360 bp, artificial
  22D1 - HCVR
caggtgcagctggtgcagtctggggctgaggtgaagaagcctggggcctcagtgagggtttcctgcaaggtttctggatacaccttcaccagctactttattcactgggtacgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctca

SEQ ID NO: 366 - protein, 120 aa, artificial
  22D1 - HCVR
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSS

SEQ ID NO: 367 - DNA, 360 bp, artificial
  19B5 - HCVR
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctca

SEQ ID NO: 368 - protein, 120 aa, artificial
  19B5 - HCVR
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSS

SEQ ID NO: 369 - DNA, 360 bp, artificial
  25F8 - HCVR
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtcttcatggagctgagcagcctgagatctgaggacacggccgtgtattactgtgcgcgagggggaatacagctatggttacattttgactactggggccagggaaccctggtcaccgtctcctca

SEQ ID NO: 370 - protein, 120 aa, artificial
  25F8 - HCVR
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSS

SEQ ID NO: 371 - DNA, 360 bp, artificial
  26D1 - HCVR
caggtgcagttggtgcagtctggggctgaggtgaagaagcctggggcctcagtgaaggtttcctgtaaggcatctagatacaccttcaccagctactatatgtcctgggtgcgacaggcccctggacaagggcttgagtggatgggaataatccaccctagtggtggtgacacaacctacgcacagaagttccagggcagagtcaccatgaccggggacacgtccacgagcacagtctacatggagctgagcagcctgagatctgaggacacggccgtgtattactgtgcgagaggggggataaaactatggttacattttgactattggggccagggaaccctggtcaccgtctcctca

SEQ ID NO: 372 - protein, 120 aa, artificial
  26D1 - HCVR
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSS

SEQ ID NO: 373 - DNA, 357 bp, artificial
  4D2- -HCVR
caggtgcagctggtggagtctgggggaggcgtggtccagcctgggaggtccctgagactctcctgtgcagcctctggattcaccttcagtagttatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagtgtctcctca

SEQ ID NO: 374 - protein, 119 aa, artificial; identical to SEQ ID NO: 346
  4D2- -HCVR

SEQ ID NO: 375 - DNA, 357 bp, artificial
  4E10 - HCVR
caggtgcagctggtggagtctgggggaggcgtggtccagcctgggaggtccctgagactctcctgtgcagcgtctggattcaccttcagtagctatgacatgcactgggtccgccaggctccaggcaaggggctggagtgggtggcagttatatggtatgatggaagtaataaatactatgcagactccgtgaagggccgattcaccatctccagagacaattccacgaacacgctgcatctgcaaatgaacagcccgagagccgaggacacggctgtgtactactgtgcgagagagtataggtacagctggtactttgactactggggccagggaaccctggtcaccgtctcctca

SEQ ID NO: 376 - protein, 119 aa, artificial
  4E10 - HCVR
QVQLVESGGGVVQPGRSLRLSCAASGFTFSSYDMHWVRQAPGKGLEWVAVIWYDGSNKYYADSVKGRFTISRDNSTNTLHLQMNSPRAEDTAVYYCAREYRYSWYFDYWGQGTLVTVSS

SEQ ID NO: 377 - DNA, 363 bp, artificial
  22G10 - HCVR
gaggtgcaactgttggagtctgggggaggcttggtacagcctggggggtccctgagactctcctgtgcagcctctggattcacctttagcagttatgccatgaactgggtccgccaggctccagggaaggggctggagtgggtctcaactattagtggtggtggtgctaacacatactacgcagactccgtgaagggccggttcaccatctccagtgacaattccaagagcacgctgtatctgcaaatgaacagcctgagagccgcggacacggccgtatatcactgtgcgaaagggggaatggggggatactactacggtatggacgtctggggccaagggaccacggtcaccgtctcctca

SEQ ID NO: 378 - protein, 121 aa, artificial
  22G10 - HCVR
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSS

SEQ ID NO: 379 - DNA, 375 bp, artificial; identical to SEQ ID NO: 351
  2C12_LC#1 - HCVR

SEQ ID NO: 380 - protein, 125 aa, artificial; identical to SEQ ID NO: 352
  2C12_LC#1 - HCVR

SEQ ID NO: 381 - DNA, 375 bp, artificial
  2H12_LC#2 - HCVR
caggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatacagactccgtgaagggccgattcaccatctccagagacaattccaagaacacgctgtatctgcaaatgaatagcctgagagctgaggacacggctgtgtattactgtgcgagaagggccggtataataggaactacaggctactactacggtatggacgtctggggccaagggaccacggtcaccgtctcctca

SEQ ID NO: 382 - protein, 125 aa, artificial
  2H12_LC#2 - HCVR
QVQLVESGGGVVQPGRSLRLSCAASGFTFSSYGMHWVRQAPGKGLEWVAVIWYDGSNKYYTDSVKGRFTISRDNSKNTLYLQMNSLRAEDTAVYYCARRAGIIGTTGYYYGMDVWGQGTTVTVSS

SEQ ID NO: 383 - DNA, 375 bp, artificial
  2G6_LC#1 - HCVR
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctcctca

SEQ ID NO: 384 - protein, 125 aa, artificial
  2G6_LC#1 - HCVR
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSS

SEQ ID NO: 385 - DNA, 375 bp, artificial; identical to SEQ ID NO: 381
  2H12 - HCVR

SEQ ID NO: 386 - protein, 125 aa, artificial; identical to SEQ ID NO: 382
  2H12 - HCVR

SEQ ID NO: 387 - DNA, 375 bp, artificial; identical to SEQ ID NO: 383
  2G6 - HCVR

SEQ ID NO: 388 - protein, 125 aa, artificial; identical to SEQ ID NO: 384
  2G6 - HCVR

SEQ ID NO: 389 - DNA, 375 bp, artificial
  23A10 - HCVR
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgctaatgaacagcctgagagccgaggactcggctgtgtattactgtgcgagaagggccggtatacctggaactacgggctactactatggtatggacgtctggggccaagggaccacggtcaccgtctcctca

SEQ ID NO: 390 - protein, 125 aa, artificial
  23A10 - HCVR
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSS

SEQ ID NO: 391 - DNA, 369 bp, artificial
  5E3 - HCVR
gaggtgcagttggtggagtctgggggaggcctggtcaagcctggggggtccctgagactctcctgtgcagcctctggattcaccttcagtagctatagcatgcactgggtccgccaggctccagggaaggggctggagtgggtctcatccattagtagtagtagtagttacatatactacgcagactcagtgaagggccgattcaccatctccagagacaacgccaagaactcactgtatctgcaaatgaacagcctgagagccgaggacacggctgtgtattactgtgcgagaggggaaactggaactaactactactactacggtatggacgtctggggccaagggaccacggtcaccgtctcctca

SEQ ID NO: 392 - protein, 123 aa, artificial
  5E3 - HCVR
EVQLVESGGGLVKPGGSLRLSCAASGFTFSSYSMHWVRQAPGKGLEWVSSISSSSSYIYYADSVKGRFTISRDNAKNSLYLQMNSLRAEDTAVYYCARGETGTNYYYYGMDVWGQGTTVTVSS

SEQ ID NO: 393 - DNA, 327 bp, artificial
  17H8, 23B6, 28D10 -LCVR
gacattgtattgacgcagtctccaggcaccctgtctttgtctccaggggaaagagccaccctctcctgcagggccagtcagagtgttgccggcagctacctagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtaaatcaccgatcaccttcggccaagggacacgactggagatgaaagga

SEQ ID NO: 394 - protein, 109 aa, artificial
  17H8, 23B6, 28D10 -LCVR
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKG

SEQ ID NO: 395 - DNA, 324 bp, artificial
  4A2, 5B4, 5C5 - LCVR
gaaattgtgttgacgcagtctccaggcaccctgtctttgtctccaggggaaagagccaccctctcttgcagggccagtcggaatattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttacagtgtattactgtcagcagtatggtagctcattcactttcggccctgggaccaaagtggatatcaaacga

SEQ ID NO: 396 - protein, 108 aa, artificial
  4A2, 5B4, 5C5 - LCVR
EIVLTQSPGTLSLSPGERATLSCRASRNISSSYLAWYQQKPGQAPRLLIYGPSSRATGIPDRFSGSGSGTDFTLTISRLEPEDFTVYYCQQYGSSFTFGPGTKVDIKR

SEQ ID NO: 397 - DNA, 333 bp, artificial
  16H2, 20D3, 23E7 - LCVR
cagtctgcgctgactcagccaccctcagcgactgggacccccgggcagagggtcaccatctcttgttctggaagcagctccaacatcggaagtaattttgtaaactggtacaaacaactcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagcctgaatggttgggtgttcggcggagggaccaagctgaccgtcctaggt

SEQ ID NO: 398 - protein, 111 aa, artificial
  16H2, 20D3, 23E7 - LCVR
QSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLG

SEQ ID NO: 399 - DNA, 333 bp, artificial
  26F12, 27B3 - LCVR
cagtctgtgctgactcagtcaccctcagcgtctgggacccccgggcagaaggtcaccatctcttgttctggaagccgctccaacatcggaagtaattttgtaaactggtaccagcagctcccaggaacggcccccaaactcctcatctatactaattatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggt

SEQ ID NO: 400 - protein, 111 aa, artificial
  26F12, 27B3 - LCVR
QSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLG

SEQ ID NO: 401 - DNA, 324 bp, artificial
  4B10, 4C2 - LCVR
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccactggcatcccagacagattcagtggcagtgggtctgggacagacttcgctctcaccatcagcagtctggagcctgaagattttgcagtgtattactgtcagcagtacagtaactcgtggacgttcggccaagggaccaaggtggaaatcaaacga

SEQ ID NO: 402 - protein, 108 aa, artificial
  4B10, 4C2 - LCVR
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKR

SEQ ID NO: 403 - DNA, 324 bp, artificial
  4D3, 4F3 - LCVR
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaggattttgcagtgtattactgtcagcagtatggtagctcgtggacgttcggccaagggaccaaggtggaaatcaaacga

SEQ ID NO: 404 - protein, 108 aa, artificial
  4D3, 4F3 - LCVR
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKR

SEQ ID NO: 405 - DNA, 324 bp, artificial
  16E2, 17E10, 20B12 - LCVR
gacatccagatgacccagtctccatcctcactgtctgcatctgtaggagacagagtcaccatcacttgtcgggcgagtcagggcattagcaattatttagcctggttacagcagaaaccagggaaagcccctaagtccctgatctatgctgcatccagtttgcaaagtggggtcccatcaaagttcagcggcagtggatctgggacagatttcactctcaccatcagcagcctgcagcctgaagattttgcaacttattactgccaacactattttacttaccctcggacgttcggccaagggaccaaggtggaaatcaaacga

SEQ ID NO: 406 - protein, 108 aa, artificial
  16E2, 17E10, 20B12 - LCVR
DIQMTQSPSSLSASVGDRVTITCRASQGISNYLAWLQQKPGKAPKSLIYAASSLQSGVPSKFSGSGSGTDFTLTISSLQPEDFATYYCQHYFTYPRTFGQGTKVEIKR

SEQ ID NO: 407 - DNA, 321 bp, artificial
  1D10, 2C12 - LCVR
tcctatgcgctgactcagccaccctcagtgtccgtgtccccaggacagacagccagcctcacctgctctggagatagattgggggaaaaatatacttgctggtatcagcagaggccaggccagtcccctttgctggtcatctatcaagataccaagcggccctcagggatccctgagcgattctctggctccacctctggtaacacagccactctgaccatcagcgggacccaggctatggatgaggctgactattactgtcaggcgtgggacagcagcactgtggtattcggcggagggaccaagctgaccgtcctaggt

SEQ ID NO: 408 - protein, 107 aa, artificial
  1D10, 2C12 - LCVR
SYALTQPPSVSVSPGQTASLTCSGDRLGEKYTCWYQQRPGQSPLLVIYQDTKRPSGIPERFSGSTSGNTATLTISGTQAMDEADYYCQAWDSSTVVFGGGTKLTVLG

SEQ ID NO: 409 - DNA, 327 bp, artificial
  16C1 - LCVR
gaaattgtgttgacgcagtctccaggcaccctgtctttgtctccaggggaaagagccaccctctcctgcagggccagccagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcggactggagcctgaagattttgcagtgtatcactgtcagcagtatggtaactcaccgctcactttcggcggagggaccaaggtggagatcaaacga

SEQ ID NO: 410 - protein, 109 aa, artificial
  16C1 - LCVR
EIVLTQSPGTLSLSPGERATLSCRASQSVSSSYLAWYQQKPGQAPRLLIFGASSRATGIPDRFSGSGSGTDFTLTISGLEPEDFAVYHCQQYGNSPLTFGGGTKVEIKR

SEQ ID NO: 411 - DNA, 327 bp, artificial
  25G10 - LCVR
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatcactgtcagcagtatggtaactcaccgctcactttcggcggagggaccaaggtggagatcaaacga

SEQ ID NO: 412 - protein, 109 aa, artificial
  25G10
EIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIKR

SEQ ID NO: 413 - DNA, 327 bp, artificial
  16A4 - LCVR
gaaattgtgttgacgcagtctccaggcaccctgtctttgtctccaggggaaagagccaccctctcctgcagggccagtcagagtgttagcagcagttatttagcctggtaccagcagaaacctggccaggctcccaggctcctcatctatggtacatccagcagggccactggcatcccagacaggttcagtggcagtgggtctgggacagacttcactctcaccatcagcagactggagcctgaagattttgcagtgtattattgtcagcagtacggtagctcacctttcactttcggcggagggaccaaggtggagatcaaacga

SEQ ID NO: 414 - protein, 109 aa, artificial
  16A4 - LCVR
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKR

SEQ ID NO: 415 - DNA, 324 bp, artificial
  1F10 - LCVR
gaaattgtgttgacgcagtctccaggcaccctgtctttgtctccaggggaaagagccaccctctcctgcagggccagtcggagtattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttgcagtgtattactgtcagcagtatggtagctcattcactttcggccctgggaccaaagtggatatcaaacga

SEQ ID NO: 416 - protein, 108 aa, artificial
  1F10 - LCVR
EIVLTQSPGTLSLSPGERATLSCRASRSISSSYLAWYQQKPGQAPRLLIYGPSSRATGIPDRFSGSGSGTDFTLTISRLEPEDFAVYYCQQYGSSFTFGPGTKVDIKR

SEQ ID NO: 417 - DNA, 336 bp, artificial
  4A9 - LCVR
cagtctgtgctgacgcagccgccctcagtgtctggggccccaggacagagggtcaccatctcctgcactgggagcagctccaacatcgggacaggttatgctgtacactggtaccagcagtttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtcctaggt

SEQ ID NO: 418 - protein, 112 aa, artificial
  4A9 - LCVR
QSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVLG

SEQ ID NO: 419 - DNA, 336 bp, artificial
  4F7 - LCVR
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtcctaggt

SEQ ID NO: 420 - protein, 112 aa, artificial
  4F7 - LCVR
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVLG

SEQ ID NO: 421 - DNA, 333 bp, artificial
  22D1 - LCVR
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagtatgaatggttgggtgttcggcggagggaccaagctgaccgtcctaggt

SEQ ID NO: 422 - protein, 111 aa, artificial
  22D1 - LCVR
QSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVLG

SEQ ID NO: 423 - DNA, 333 bp, artificial
  19B5 - LCVR
cagtctgcgctgactcagccaccctcaacgactgggacccccgggcagagggtcaccatctcttgttctggaagcaggtccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgcgcaacatgggatgacagtatgaatggttgggtgttcggcggagggaccaaactgaccgtcctaggt

SEQ ID NO: 424 - protein, 111 aa, artificial
  19B5 - LCVR
QSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVLG

SEQ ID NO: 425 - DNA, 333 bp, artificial
  25F8 - LCVR
cagtctgcgctgactcagccaccctcagcgactgggacccccgggcagagggtcaccatctcttgttctggaagcagctccaacatcggaaggaattttgtaaactggtataagcagctcccaggaacggcccccaaagtcctcatttatactaataatcagcggccctcaggggtccctgaccgattctctggctccaagtctggcacctcagcctccctggccatcagtgggctccagtctgaggatgagtctgattattactgtgcagcatgggatgacagcctgaatggttgggtgttcggcggagggaccaagctgaccgtcctaggt

SEQ ID NO: 426 - protein, 111 aa, artificial
  25F8 - LCVR
QSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVLG

SEQ ID NO: 427 - DNA, 333 bp, artificial
  26D1 - LCVR
cactctgtgctgactcagtcaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggt

SEQ ID NO: 428 - protein, 111 aa, artificial
  26D1 - LCVR
HSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 429 - DNA, 324 bp, artificial
  4D2 - LCVR
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccgctggcatcccagacaggttcagtggcagtgggtctgggacagacttcactctcaccatcagcagactggagcctgaagattttgcagtgtattactgtcagcagtatagtaactcgtggacgttcggccaagggaccaaggtggaaatcaaacga

SEQ ID NO: 430 - protein, 108 aa, artificial
  4D2 - LCVR
EIVLTQSPGTLSLSPGERATLSCRASQSVSNTYLAWYHQRPGQAPRLLIYGASSRAAGIPDRFSGSGSGTDFTLTISRLEPEDFAVYYCQQYSNSWTFGQGTKVEIKR

SEQ ID NO: 431 - DNA, 324 bp, artificial
  4E10 - LCVR
gaaattgtgttgacgcagtctccaggcaccctgtctttgtctccaggggaaagagccaccctctcctgcagggccagtcagagtgttggcagcagctacttagcctggtaccagcagaaacctggccaggctcccaggctcctcatctatggtgcatccagcagggtcactggcatcccagacaggttcagtggcagtgggtctgggacagatttcactctcaccatcagcagactggagcctgaagattttgcagtgtattactgtcagcaatatagtaactcgtggacgttcggccaagggaccaaggtggaaatcaaacga

SEQ ID NO: 432 - protein, 108 aa, artificial
  4E10 - LCVR
EIVLTQSPGTLSLSPGERATLSCRASQSVGSSYLAWYQQKPGQAPRLLIYGASSRVTGIPDRFSGSGSGTDFTLTISRLEPEDFAVYYCQQYSNSWTFGQGTKVEIKR

SEQ ID NO: 433 - DNA, 324 bp, artificial
  22G10 - LCVR
gaaatagtgatgacgcagtctccagtcaccctgtctctgtctctaggggaaagagccaccctctcctgcagggccagtcagagtattagcagcaacttagcctggttccagcagaaacctggccaggctcccagactcctcatctatggtgcatttaccagggccactggtatcccagccagggtcagtggcagtgggtctgggacagagttcactctcaccatcagcagcctgcagtctgaagattttgcagtttattactgtcagcagtataattactggccgctcactttcggcggagggaccaaggtggagatcaagcga

SEQ ID NO: 434 - protein, 108 aa, artificial
  22G10 - LCVR
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKR

SEQ ID NO: 435 - DNA, 339 bp, artificial
  2C12_LC#1 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagattcagcggcagtgggtcaggcactgatttcacactgaaaatcagcagggtggaggctgaggatgttggggtttattactgcatgcaaggtatagtgtggccgtgcagttttggccaggggaccaagctggagatcaaacga

SEQ ID NO: 436 - protein, 113 aa, artificial
  2C12_LC#1 - LCVR
DVVMTQSPLSLPVTLGQPASISCRSSQSLVYSDGNTYLNWFQQRPGQSPRRLIYKVSNWDSGVPDRFSGSGSGTDFTLKISRVEAEDVGVYYCMQGIVWPCSFGQGTKLEIKR

SEQ ID NO: 437 - DNA, 339 bp, artificial
  2H12_LC#2 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaactgggactctggggtcccagacagaatcagcggcagtgggtcaggcaccgatttcacactgaaaatcagcagggtggaggctgaggatgttggggtttattactgcatgcaagatacactgtggccgtgcagttttggccaggggaccaagctggagatcaaacga

SEQ ID NO: 438 - protein, 113 aa, artificial
  2H12_LC#2 - LCVR
DVVMTQSPLSLPVTLGQPASISCRSSQSLVYSDGNTYLNWFQQRPGQSPRRLIYKVSNWDSGVPDRISGSGSGTDFTLKISRVEAEDVGVYYCMQDTLWPCSFGQGTKLEIKR

SEQ ID NO: 439 - DNA, 339 bp, artificial
  2G6_LC#1 - LCVR
gatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccacggcgcctaatttatcaggtttctaactgggactctggggtcccagacagattcagcggcagtgggtcaggcactgatttcacactgaaaatcagcagggtggaggctgaggatgttgggatttattactgcatgcaagatacactgtggccgtgcagttttggccaggggaccaagctggagatcaaacga

SEQ ID NO: 440 - protein, 113 aa, artificial
  2G6_LC#1 - LCVR
DVVMTQSPLSLPVTLGQPASISCRSSQSLVYSDGNTYLNWFQQRPGQSPRRLIYQVSNWDSGVPDRFSGSGSGTDFTLKISRVEAEDVGIYYCMQDTLWPCSFGQGTKLEIKR

SEQ ID NO: 441 - DNA, 321 bp, artificial
  2H12 - LCVR
tcctatgagctgactcagccaccctcagtgtccgtgtccccaggacagacagccagcatcacctgctctggagatagattgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccagcctatggatgaggctgactattactgtcaggcgtgggacagcagcactgtggtattcggcggagggaccaagctgaccgtcctaggt

SEQ ID NO: 442 - protein, 107 aa, artificial
  2H12 - LCVR
SYELTQPPSVSVSPGQTASITCSGDRLGEKYTCWYQQRPGQSPLLVIYQDTKRPSGIPERFSGSNSGNTATLTISGTQPMDEADYYCQAWDSSTVVFGGGTKLTVLG

SEQ ID NO: 443 - DNA, 321 bp, artificial
  2G6 - LCVR
tcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggacagcagcactgtggtattcggcggagggaccaagctgaccgtcctaggt

SEQ ID NO: 444 - protein, 107 aa, artificial
  2G6 - LCVR
SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVLG

SEQ ID NO: 445 - DNA, 321 bp, artificial
  23A10 - LCVR
tcctatgagctgactcagccaccctcagtgtccgtgtccccaggacagacagccagcatcacctgctctggagatagattgggggagaaatatgtttgctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtcctaggt

SEQ ID NO: 446 - protein, 107 aa, artificial
  23A10 - LCVR
SYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVLG

SEQ ID NO: 447 - DNA, 321 bp, artificial
  5E3 - LCVR
tcctatgagctgactcagccaccctcagtgtccgtgtccccaggacagacagccagcatcacctgctctggagataaattgggggatgaatatgcttgctggtatcagcagaagccaggccagtcccctgtgctggtcatctatcaagatagcaagcggccctcagggatccctgagcgattctctggctccaactctgggaacacagccactctgaccatcagcgggacccaggctatggatgaggctgactattactgtcaggcgtgggacagcagcactgtggtattcggcggagggaccaagctgaccgtcctaggt

SEQ ID NO: 448 - protein, 107 aa, artificial
  5E3 - LCVR
SYELTQPPSVSVSPGQTASITCSGDKLGDEYACWYQQKPGQSPVLVIYQDSKRPSGIPERFSGSNSGNTATLTISGTQAMDEADYYCQAWDSSTVVFGGGTKLTVLG

SEQ ID NO: 449 - protein, 119 aa, artificial; identical to SEQ ID NO: 348
  4F3 VH

SEQ ID NO: 450 - protein, 116 aa, artificial; identical to SEQ ID NO: 362
  4A9 VH

SEQ ID NO: 451 - protein, 119 aa, artificial; identical to SEQ ID NO: 346
  4B10 VH

SEQ ID NO: 452 - protein, 122 aa, artificial; identical to SEQ ID NO: 338
  17H8.2 VH

SEQ ID NO: 453 - protein, 120 aa, artificial; identical to SEQ ID NO: 354
  16C1.1 VH

SEQ ID NO: 454 - protein, 125 aa, artificial; identical to SEQ ID NO: 358
  16A4.1 VH

SEQ ID NO: 455 - protein, 121 aa, artificial; identical to SEQ ID NO: 378
  22G10.1 VH

SEQ ID NO: 456 - protein, 120 aa, artificial; identical to SEQ ID NO: 342
  20D3.1 VH

SEQ ID NO: 457 - protein, 120 aa, artificial; identical to SEQ ID NO: 366
  22D1.1 VH

SEQ ID NO: 458 - protein, 120 aa, artificial; identical to SEQ ID NO: 370
  25F8.1 VH

SEQ ID NO: 459 - protein, 120 aa, artificial; identical to SEQ ID NO: 344
  26F12.1 VH

SEQ ID NO: 460 - protein, 120 aa, artificial; identical to SEQ ID NO: 372
  26D1.1 VH

SEQ ID NO: 461 - protein, 120 aa, artificial
  25G10.1 VH
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSS

SEQ ID NO: 462 - protein, 120 aa, artificial; identical to SEQ ID NO: 368
  19B5.1 VH

SEQ ID NO: 463 - protein, 120 aa, artificial; identical to SEQ ID NO: 340
  4A2 VH

SEQ ID NO: 464 - protein, 120 aa, artificial
  4A2 (1-472)(Q17E,H47P) VH
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSS

SEQ ID NO: 465 - protein, 120 aa, artificial; identical to SEQ ID NO: 340
  4A2 VH

SEQ ID NO: 466 - protein, 120 aa, artificial; identical to SEQ ID NO: 464
  4A2 (1-472)(Q17E,H47P) VH

SEQ ID NO: 467 - protein, 120 aa, artificial; identical to SEQ ID NO: 464
  4A2 (1-472)(Q17E,H47P,D111E) VH

SEQ ID NO: 468 - protein, 120 aa, artificial; identical to SEQ ID NO: 464
  4A2 (1-472)(Q17E,H47P,D111E,W134Y) VH

SEQ ID NO: 469 - protein, 120 aa, artificial; identical to SEQ ID NO: 464
  4A2 VH

SEQ ID NO: 470 - protein, 120 aa, artificial; identical to SEQ ID NO: 464
  4F3 (1-471)(R17G) VH

SEQ ID NO: 471 - protein, 119 aa, artificial
  4F3 (1-471)(R17G,T47A) VH
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSS

SEQ ID NO: 472 - protein, 119 aa, artificial
  4F3 (1-471)(R17G,T47A,R141Q) VH
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSS

SEQ ID NO: 473 - protein, 119 aa, artificial
  4F3 (1-471)(R17G,T47A,D61E,D72E,R141Q) VH
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSS

SEQ ID NO: 474 - protein, 119 aa, artificial
  4F3 (1-471)(R17G,T47A,D61E,D72E,W134Y,R141Q) VH
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGYYFDLWGQGTLVTVSS

SEQ ID NO: 475 - protein, 125 aa, artificial
  2G6 (1-477)(R17G,D61E,D72E,K94N) VH
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 476 - protein, 120 aa, artificial; identical to SEQ ID NO: 354
  16C1.1 VH

SEQ ID NO: 477 - protein, 120 aa, artificial
  16C1.1 (1-469)(T92K) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGWYRWFDPWGQGTLVTVSS

SEQ ID NO: 478 - protein, 120 aa, artificial
  16C1.1 (1-469)(T92K,D109E) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCAREGSSGWYRWFDPWGQGTLVTVSS

SEQ ID NO: 479 - protein, 120 aa, artificial
  16C1.1 (1-469)(T92K,W132Y,W135Y) VH
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGYYRYFDPWGQGTLVTVSS

SEQ ID NO: 480 - protein, 120 aa, artificial; identical to SEQ ID NO: 477
  16C1.1 (1-469)(T92K) VH

SEQ ID NO: 481 - protein, 122 aa, artificial; identical to SEQ ID NO: 338
  17H8.2 VH

SEQ ID NO: 482 - protein, 122 aa, artificial
  17H8.2 (1-471)(D109E) VH
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGWYDAFDIWGQGTMVTVSS

SEQ ID NO: 483 - protein, 122 aa, artificial
  17H8.2 (1-471)(D109E,W132Y) VH
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGYYDAFDIWGQGTMVTVSS

SEQ ID NO: 484 - protein, 122 aa, artificial; identical to SEQ ID NO: 482
  17H8.2 (1-471)(D109E) VH

SEQ ID NO: 485 - protein, 116 aa, artificial; identical to SEQ ID NO: 364
  4F7 VH

SEQ ID NO: 486 - protein, 116 aa, artificial; identical to SEQ ID NO: 364
  4F7 VH

SEQ ID NO: 487 - protein, 116 aa, artificial
  4F7 (1-468)(W113Y) VH
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNYAFHFDYWGQGTLVTVSS

SEQ ID NO: 488 - protein, 119 aa, artificial
  4B10 (1-471)(R17G,D61E,D72E,W134Y) VH
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDYSFDYWGQGTLVSVSS

SEQ ID NO: 489 - protein, 119 aa, artificial; identical to SEQ ID NO: 346
  4B10 VH

SEQ ID NO: 490 - protein, 119 aa, artificial
  4B10 (1-471)(R17G) VH
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSS

SEQ ID NO: 491 - protein, 119 aa, artificial
  4B10 (1-471)(R17G,D61E,D72E) VH
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSS

SEQ ID NO: 492 - protein, 116 aa, artificial; identical to SEQ ID NO: 362
  4A9 VH

SEQ ID NO: 493 - protein, 116 aa, artificial
  4A9 (1-468)(F55I,A56G) VH
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSS

SEQ ID NO: 494 - protein, 116 aa, artificial; identical to SEQ ID NO: 493
  4A9 (1-468)(F55I,A56G) VH

SEQ ID NO: 495 - protein, 116 aa, artificial
  4A9 (1-468)(F55I,A56G,W113Y) VH
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNYAFHFDFWGQGTLVTVSS

SEQ ID NO: 496 - protein, 120 aa, artificial; identical to SEQ ID NO: 342
  20D3.1 VH

SEQ ID NO: 497 - protein, 120 aa, artificial; identical to SEQ ID NO: 342
  20D3.1 VH

SEQ ID NO: 498 - protein, 120 aa, artificial
  20D3.1 (1-469)(W133Y) VH
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHFDYWGQGTLVTVSS

SEQ ID NO: 499 - protein, 120 aa, artificial; identical to SEQ ID NO: 498
  20D3.1 (1-469)(W133Y) VH

SEQ ID NO: 500 - protein, 120 aa, artificial; identical to SEQ ID NO: 498
  20D3.1 (1-469)(W133Y) VH

SEQ ID NO: 501 - protein, 121 aa, artificial
  22G10.1 (1-470)(S82R,A99E) VH
EVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSS

SEQ ID NO: 502 - protein, 121 aa, artificial; identical to SEQ ID NO: 501
  22G10.1 (1-470)(A99E,H105Y) VH

SEQ ID NO: 503 - protein, 121 aa, artificial
  22G10.1 (1-470)(A99E) VH
EVQLLESGGGLVQPGGSLRLSCAASGFTFSSYAMNWVRQAPGKGLEWVSTISGGGANTYYADSVKGRFTISSDNSKSTLYLQMNSLRAEDTAVYHCAKGGMGGYYYGMDVWGQGTTVTVSS

SEQ ID NO: 504 - protein, 121 aa, artificial; identical to SEQ ID NO: 503
  22G10.1 (1-470)(A99E) VH

SEQ ID NO: 505 - protein, 121 aa, artificial
  22G10.1 (1-470)(D72E,A99E) VH
EVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTTVTVSS

SEQ ID NO: 506 - protein, 121 aa, artificial
  22G10.1 (1-470)(H105Y) VH
EVQLLESGGGLVQPGGSLRLSCAASGFTFSSYAMNWVRQAPGKGLEWVSTISGGGANTYYADSVKGRFTISSDNSKSTLYLQMNSLRAADTAVYYCAKGGMGGYYYGMDVWGQGTTVTVSS

SEQ ID NO: 507 - protein, 125 aa, artificial
  16A4.1 (1-474)(T144L) VH
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSS

SEQ ID NO: 508 - protein, 120 aa, artificial; identical to SEQ ID NO: 368
  19B5.1 VH

SEQ ID NO: 509 - protein, 120 aa, artificial
  19B5.1 (1-469)(W133Y) VH
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSS

SEQ ID NO: 510 - protein, 120 aa, artificial; identical to SEQ ID NO: 368
  19B5.1 VH

SEQ ID NO: 511 - protein, 120 aa, artificial; identical to SEQ ID NO: 368
  19B5.1 VH

SEQ ID NO: 512 - protein, 120 aa, artificial; identical to SEQ ID NO: 509
  19B5.1 (1-469)(W133Y) VH

SEQ ID NO: 513 - protein, 125 aa, artificial
  23A10.3 (1-474)(L92Q) VH
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSS

SEQ ID NO: 514 - protein, 125 aa, artificial
  23A10.3 (1-474)(R17G,L92Q) VH
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSS

SEQ ID NO: 515 - protein, 125 aa, artificial
  23A10.3 (1-474)(R17G,D61E,D72E,L92Q) VH
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSS

SEQ ID NO: 516 - protein, 125 aa, artificial; identical to SEQ ID NO: 390
  23A10.3 VH

SEQ ID NO: 517 - protein, 120 aa, artificial; identical to SEQ ID NO: 461
  25G10.1 VH

SEQ ID NO: 518 - protein, 120 aa, artificial
  25G10.1 (1-469)(D109E,W132Y,W135Y) VH
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCAREGSSGYYRYFDPWGQGTLVTVSS

SEQ ID NO: 519 - protein, 120 aa, artificial; identical to SEQ ID NO: 372
  26D1.1 VH

SEQ ID NO: 520 - protein, 120 aa, artificial; identical to SEQ ID NO: 372
  26D1.1 VH

SEQ ID NO: 521 - protein, 120 aa, artificial; identical to SEQ ID NO: 372
  26D1.1 VH

SEQ ID NO: 522 - protein, 120 aa, artificial; identical to SEQ ID NO: 372
  26D1.1 VH

SEQ ID NO: 523 - protein, 120 aa, artificial
  26D1.1 (1-469)(W133Y) VH
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLYLHFDYWGQGTLVTVSS

SEQ ID NO: 524 - protein, 120 aa, artificial
  26D1.1 (1-469)(R27G,G82R) VH
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSS

SEQ ID NO: 525 - protein, 120 aa, artificial; identical to SEQ ID NO: 344
  26F12.1 VH

SEQ ID NO: 526 - protein, 120 aa, artificial; identical to SEQ ID NO: 344
  26F12.1 VH

SEQ ID NO: 527 - protein, 120 aa, artificial
  26F12.1 (1-469)(W133Y) VH
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLYLHFDYWGQGTLVTVSS

SEQ ID NO: 528 - protein, 120 aa, artificial; identical to SEQ ID NO: 527
  26F12.1 (1-469)(W133Y) VH

SEQ ID NO: 529 - protein, 120 aa, artificial; identical to SEQ ID NO: 370
  25F8.1 VH

SEQ ID NO: 530 - protein, 120 aa, artificial; identical to SEQ ID NO: 370
  25F8.1 VH

SEQ ID NO: 531 - protein, 120 aa, artificial
  25F8.1 (1-469)(F90Y) VH
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSS

SEQ ID NO: 532 - protein, 120 aa, artificial; identical to SEQ ID NO: 531
  25F8.1 (1-469)(F90Y) VH

SEQ ID NO: 533 - protein, 120 aa, artificial
  25F8.1 (1-469)(F90Y,W133Y) VH
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLYLHFDYWGQGTLVTVSS

SEQ ID NO: 534 - protein, 120 aa, artificial; identical to SEQ ID NO: 366
  22D1.1 VH

SEQ ID NO: 535 - protein, 120 aa, artificial; identical to SEQ ID NO: 366
  22D1.1 VH

SEQ ID NO: 536 - protein, 120 aa, artificial
  22D1.1 (1-469)(W133Y) VH
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSS

SEQ ID NO: 537 - protein, 120 aa, artificial; identical to SEQ ID NO: 536
  22D1.1 (1-469)(W133Y) VH

SEQ ID NO: 538 - protein, 120 aa, artificial
  22D1.1 (1-469)(F90Y) VH
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSS

SEQ ID NO: 539 - protein, 116 aa, artificial; identical to SEQ ID NO: 364
  4F7 VH

SEQ ID NO: 540 - protein, 125 aa, artificial; identical to SEQ ID NO: 384
  2G6 VH

SEQ ID NO: 541 - protein, 125 aa, artificial
  2G6 (1-477)(R17G,K94N) VH
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 542 - protein, 125 aa, artificial
  2G6 (1-477)(D61E,D72E) VH
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSS

SEQ ID NO: 543 - protein, 125 aa, artificial
  2G6 (1-477)(R17G) VH
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSS

SEQ ID NO: 544 - protein, 108 aa, artificial; identical to SEQ ID NO: 404
  4F3 VL

SEQ ID NO: 545 - protein, 112 aa, artificial; identical to SEQ ID NO: 418
  4A9 VL

SEQ ID NO: 546 - protein, 108 aa, artificial; identical to SEQ ID NO: 402
  4B10 VL

SEQ ID NO: 547 - protein, 109 aa, artificial; identical to SEQ ID NO: 394
  17H8.2 VL

SEQ ID NO: 548 - protein, 109 aa, artificial; identical to SEQ ID NO: 410
  16C1.1 VL

SEQ ID NO: 549 - protein, 109 aa, artificial; identical to SEQ ID NO: 414
  16A4.1 VL

SEQ ID NO: 550 - protein, 108 aa, artificial; identical to SEQ ID NO: 434
  22G10.1 VL

SEQ ID NO: 551 - protein, 111 aa, artificial; identical to SEQ ID NO: 398
  20D3.1 VL

SEQ ID NO: 552 - protein, 111 aa, artificial; identical to SEQ ID NO: 422
  22D1.1 VL

SEQ ID NO: 553 - protein, 111 aa, artificial; identical to SEQ ID NO: 426
  25F8.1 VL

SEQ ID NO: 554 - protein, 111 aa, artificial; identical to SEQ ID NO: 400
  26F12.1 VL

SEQ ID NO: 555 - protein, 111 aa, artificial; identical to SEQ ID NO: 428
  26D1.1 VL

SEQ ID NO: 556 - protein, 109 aa, artificial; identical to SEQ ID NO: 412
  25G10.1 VL

SEQ ID NO: 557 - protein, 111 aa, artificial; identical to SEQ ID NO: 424
  19B5.1 VL

SEQ ID NO: 558 - protein, 108 aa, artificial
  4A2 (1-236)(N30Q) VL
EIVLTQSPGTLSLSPGERATLSCRASRQISSSYLAWYQQKPGQAPRLLIYGPSSRATGIPDRFSGSGSGTDFTLTISRLEPEDFTVYYCQQYGSSFTFGPGTKVDIKR

SEQ ID NO: 559 - protein, 108 aa, artificial
  4A2 (1-236)(N30Q,T102A,P141Q) VL
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKR

SEQ ID NO: 560 - protein, 108 aa, artificial
  4A2 (1-236)(N30Q,T102A) VL
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKR

SEQ ID NO: 561 - protein, 108 aa, artificial; identical to SEQ ID NO: 560
  4A2 (1-236)(N30Q,T102A) VL

SEQ ID NO: 562 - protein, 108 aa, artificial; identical to SEQ ID NO: 559
  4A2 (1-236)(N30Q,T102A,P141Q) VL

SEQ ID NO: 563 - protein, 108 aa, artificial; identical to SEQ ID NO: 559
  4A2 (1-236)(N30Q,T102A,P141Q) VL

SEQ ID NO: 564 - protein, 108 aa, artificial
  4A2 (1-236)(R29Q,N30S) VL
EIVLTQSPGTLSLSPGERATLSCRASQSISSSYLAWYQQKPGQAPRLLIYGPSSRATGIPDRFSGSGSGTDFTLTISRLEPEDFTVYYCQQYGSSFTFGPGTKVDIKR

SEQ ID NO: 565 - protein, 108 aa, artificial; identical to SEQ ID NO: 404
  4F3 VL

SEQ ID NO: 566 - protein, 108 aa, artificial; identical to SEQ ID NO: 404
  4F3 VL

SEQ ID NO: 567 - protein, 108 aa, artificial; identical to SEQ ID NO: 404
  4F3 VL

SEQ ID NO: 568 - protein, 108 aa, artificial; identical to SEQ ID NO: 404
  4F3 VL

SEQ ID NO: 569 - protein, 108 aa, artificial; identical to SEQ ID NO: 404
  4F3 VL

SEQ ID NO: 570 - protein, 107 aa, artificial
  2G6 (1-234)(C42S,D110E) VL
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLG

SEQ ID NO: 571 - protein, 109 aa, artificial
  16C1.1 (1-235)(H105Y) VL
EIVLTQSPGTLSLSPGERATLSCRASQSVSSSYLAWYQQKPGQAPRLLIFGASSRATGIPDRFSGSGSGTDFTLTISGLEPEDFAVYYCQQYGNSPLTFGGGTKVEIKR

SEQ ID NO: 572 - protein, 109 aa, artificial; identical to SEQ ID NO: 571
  16C1.1 (1-235)(H105Y) VL

SEQ ID NO: 573 - protein, 109 aa, artificial; identical to SEQ ID NO: 571
  16C1.1 (1-235)(H105Y) VL

SEQ ID NO: 574 - protein, 109 aa, artificial; identical to SEQ ID NO: 571
  16C1.1 (1-235)(H105Y) VL

SEQ ID NO: 575 - protein, 109 aa, artificial
  16C1.1 (1-235)(G95R,H105Y,G141Q) VL
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKR

SEQ ID NO: 576 - protein, 109 aa, artificial
  17H8.2 (1-235)(G149R) VL
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKR

SEQ ID NO: 577 - protein, 109 aa, artificial; identical to SEQ ID NO: 576
  17H8.2 (1-235)(G149R) VL

SEQ ID NO: 578 - protein, 109 aa, artificial; identical to SEQ ID NO: 576
  17H8.2 (1-235)(G149R) VL

SEQ ID NO: 579 - protein, 109 aa, artificial
  17H8.2 (1-235)(S57Y,G149R) VL
DIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKR

SEQ ID NO: 580 - protein, 112 aa, artificial
  4F7 (1-239)(H57Y) VL
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVLG

SEQ ID NO: 581 - protein, 112 aa, artificial
  4F7 (1-239)(H57Y,D110E) VL
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTRLTVLG

SEQ ID NO: 582 - protein, 112 aa, artificial
  4F7 (1-239)(D110E) VL
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYESSLSGWVFGGGTRLTVLG

SEQ ID NO: 583 - protein, 108 aa, artificial
  4B10 (1-236)(H45Q,A90T) VL
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKR

SEQ ID NO: 584 - protein, 108 aa, artificial; identical to SEQ ID NO: 583
  4B10 (1-236)(H45Q,A90T) VL

SEQ ID NO: 585 - protein, 108 aa, artificial; identical to SEQ ID NO: 583
  4B10 (1-236)(H45Q,A90T) VL

SEQ ID NO: 586 - protein, 108 aa, artificial; identical to SEQ ID NO: 583
  4B10 (1-236)(H45Q,A90T) VL

SEQ ID NO: 587 - protein, 112 aa, artificial
  4A9 (1-239)(F47L) VL
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLG

SEQ ID NO: 588 - protein, 112 aa, artificial; identical to SEQ ID NO: 587
  4A9 (1-239)(F47L) VL

SEQ ID NO: 589 - protein, 112 aa, artificial
  4A9 (1-239)(F47L,D110E) VL
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYESRLSGWVFGGGTKLTVLG

SEQ ID NO: 590 - protein, 112 aa, artificial; identical to SEQ ID NO: 589
  4A9 (1-239)(F47L,D110E) VL

SEQ ID NO: 591 - protein, 111 aa, artificial
  20D3.1 (1-235)(S102A) VL
QSALTQPPSATGTPGQRVTISCSGSSSNIGSNFVNWYKQLPGTAPKVLIYTNNQRPSGVPDRFSGSKSGTSASLAISGLQSEDEADYYCATWDDSLNGWVFGGGTKLTVLG

SEQ ID NO: 592 - protein, 111 aa, artificial
  20D3.1 (1-235)(K45Q,S102A) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDDSLNGWVFGGGTKLTVLG

SEQ ID NO: 593 - protein, 111 aa, artificial; identical to SEQ ID NO: 592
  20D3.1 (1-235)(K45Q,S102A) VL

SEQ ID NO: 594 - protein, 111 aa, artificial
  20D3.1 (1-235)(K45Q,S102A,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLG

SEQ ID NO: 595 - protein, 111 aa, artificial
  20D3.1 (1-235)(W109Y) VL
QSALTQPPSATGTPGQRVTISCSGSSSNIGSNFVNWYKQLPGTAPKVLIYTNNQRPSGVPDRFSGSKSGTSASLAISGLQSEDESDYYCATYDDSLNGWVFGGGTKLTVLG

SEQ ID NO: 596 - protein, 108 aa, artificial; identical to SEQ ID NO: 434
  22G10.1 VL

SEQ ID NO: 597 - protein, 108 aa, artificial; identical to SEQ ID NO: 434
  22G10.1 VL

SEQ ID NO: 598 - protein, 108 aa, artificial
  22G10.1 (1-234)(Q97E,S98P) VL
EIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKR

SEQ ID NO: 599 - protein, 108 aa, artificial
  22G10.1 (1-234)(V78F,Q97E,S98P) VL
EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKR

SEQ ID NO: 600 - protein, 108 aa, artificial; identical to SEQ ID NO: 599
  22G10.1 (1-234)(V78F,Q97E,S98P) VL

SEQ ID NO: 601 - protein, 108 aa, artificial; identical to SEQ ID NO: 434
  22G10.1 VL

SEQ ID NO: 602 - protein, 109 aa, artificial
  16A4.1 (1-235)(G141Q) VL
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKR

SEQ ID NO: 603 - protein, 111 aa, artificial
  19B5.1 (1-235)(K45Q,S102A) VL
QSALTQPPSTTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 604 - protein, 111 aa, artificial; identical to SEQ ID NO: 603
  19B5.1 (1-235)(K45Q,S102A) VL

SEQ ID NO: 605 - protein, 111 aa, artificial
  19B5.1 (1-235)(T11V,K45Q,S102A) VL
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 606 - protein, 111 aa, artificial
  19B5.1 (1-235)(T11V,K45Q,S102A,D111E,N135Q) VL
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLG

SEQ ID NO: 607 - protein, 111 aa, artificial
  19B5.1 (1-235)(T11V,K45Q,S102A,W109Y,D111E,N135Q) VL
QSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLG

SEQ ID NO: 608 - protein, 107 aa, artificial
  23A10.3 (1-231)(C42S) VL
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLG

SEQ ID NO: 609 - protein, 107 aa, artificial; identical to SEQ ID NO: 608
  23A10.3 (1-231)(C42S) VL

SEQ ID NO: 610 - protein, 107 aa, artificial
  23A10.3 (1-231)(C42S,D110E) VL
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLG

SEQ ID NO: 611 - protein, 107 aa, artificial
  23A10.3 (1-231)(C42Y) VL
SYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVLG

SEQ ID NO: 612 - protein, 109 aa, artificial
  25G10.1 (1-235)(H105Y) VL
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGGGTKVEIKR

SEQ ID NO: 613 - protein, 109 aa, artificial; identical to SEQ ID NO: 612
  25G10.1 (1-235)(H105Y) VL

SEQ ID NO: 614 - protein, 111 aa, artificial
  26D1.1 (1-235)(S7P) VL
HSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 615 - protein, 111 aa, artificial
  26D1.1 (1-235)(H1Q,S7P) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLG

SEQ ID NO: 616 - protein, 111 aa, artificial
  26D1.1 (1-235)(H1Q,S7P,W109Y) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLG

SEQ ID NO: 617 - protein, 111 aa, artificial
  26D1.1 (1-235)(H1Q,S7P,W109Y,D111E,N135Q) VL
QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLG

SEQ ID NO: 618 - protein, 111 aa, artificial; identical to SEQ ID NO: 617
  26D1.1 (1-235)(H1Q,S7P,W109Y,D111E,N135Q) VL

SEQ ID NO: 619 - protein, 111 aa, artificial; identical to SEQ ID NO: 615
  26D1.1 (1-235)(H1Q,S7P) VL

SEQ ID NO: 620 - protein, 111 aa, artificial
  26F12.1 (1-235)(S7P) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLG

SEQ ID NO: 621 - protein, 111 aa, artificial
  26F12.1 (1-235)(S7P,D111E) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLG

SEQ ID NO: 622 - protein, 111 aa, artificial; identical to SEQ ID NO: 621
  26F12.1 (1-235)(S7P,D111E) VL

SEQ ID NO: 623 - protein, 111 aa, artificial
  26F12.1 (1-235)(S7P,W109Y,D111E,N135Q) VL
QSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLG

SEQ ID NO: 624 - protein, 111 aa, artificial
  25F8.1 (1-235)(K45Q) VL
QSALTQPPSATGTPGQRVTISCSGSSSNIGRNFVNWYQQLPGTAPKVLIYTNNQRPSGVPDRFSGSKSGTSASLAISGLQSEDESDYYCAAWDDSLNGWVFGGGTKLTVLG

SEQ ID NO: 625 - protein, 111 aa, artificial
  25F8.1 (1-235)(K45Q,S102A) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDDSLNGWVFGGGTKLTVLG

SEQ ID NO: 626 - protein, 111 aa, artificial; identical to SEQ ID NO: 625
  25F8.1 (1-235)(K45Q,S102A) VL

SEQ ID NO: 627 - protein, 111 aa, artificial
  25F8.1 (1-235)(K45Q,S102A,D111E) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVLG

SEQ ID NO: 628 - protein, 111 aa, artificial
  25F8.1 (1-235)(K45Q,S102A,D111E,N135Q) VL
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLQGWVFGGGTKLTVLG

SEQ ID NO: 629 - protein, 111 aa, artificial
  22D1.1 (1-235)(K45Q,S102A) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDDSMNGWVFGGGTKLTVLG

SEQ ID NO: 630 - protein, 111 aa, artificial
  22D1.1 (1-235)(K45Q,S102A,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATWDESMQGWVFGGGTKLTVLG

SEQ ID NO: 631 - protein, 111 aa, artificial
  22D1.1 (1-235)(K45Q,S102A,W109Y,D111E,N135Q) VL
QSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLG

SEQ ID NO: 632 - protein, 111 aa, artificial
  22D1.1 (1-235)(K45Q,S102A,W109Y) VL
QSALTQPPSATGTPGQRVTISCSGSSSNIGSNFVNWYQQLPGTAPKVLIYTNNQRPSGVPDRFSGSKSGTSASLAISGLQSEDEADYYCATYDDSMNGWVFGGGTKLTVLG

SEQ ID NO: 633 - protein, 111 aa, artificial; identical to SEQ ID NO: 629
  22D1.1 (1-235)(K45Q,S102A) VL

SEQ ID NO: 634 - protein, 112 aa, artificial; identical to SEQ ID NO: 420
  4F7 VL

SEQ ID NO: 635 - protein, 107 aa, artificial
  2G6 (1-234)(D110E) VL
SYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVLG

SEQ ID NO: 636 - protein, 107 aa, artificial; identical to SEQ ID NO: 570
  2G6 (1-234)(C42S,D110E) VL

SEQ ID NO: 637 - protein, 107 aa, artificial; identical to SEQ ID NO: 570
  2G6 (1-234)(C42S,D110E) VL

SEQ ID NO: 638 - protein, 107 aa, artificial; identical to SEQ ID NO: 608
  23A10.3 (1-231)(C42S) VL

SEQ ID NO: 639 - DNA, 1368 bp, artificial
  2G6 HC
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 640 - protein, 455 aa, artificial
  2G6 HC
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - DNA, 1353 bp, artificial
  4A2 HC
caggtgcagctgcaggagtcgggcccaggactggtgaagccttcacagaccctgtccctcacctgcactgtctctggtggctccatcagcagtagtggttactactggagctggatccgccagcacccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 642 - protein, 450 aa, artificial
  4A2 HC
QVQLQESGPGLVKPSQTLSLTCTVSGGSISSSGYYWSWIRQHPGKGLEWIGYIYYTGSAYYNPSLKSRVTISVDTSKNQFSLKLSSVTAADTAVYYCARDGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 643 - DNA, 1341 bp, artificial
  4A9 HC
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 644 - protein, 446 aa, artificial
  4A9 HC
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 645 - DNA, 1350 bp, artificial
  4B10 HC
caggtgcagctggtggagtctgggggaggcgtggtccagcctgggaggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagcgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 646 - protein, 449 aa, artificial
  4B10 HC
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 647 - DNA, 1350 bp, artificial
  4F3 HC
caggtgcagctggtggagtctgggggaggcgtggtccagcctgggaggtccctgagactctcctgtgcagcgtctggattctccttcagtagctatgacatggactgggtccgccagactccaggcaaggggctggagtgggtggcagttatatggtatgatggaagtaataaatactatgcagactccgtgaggggccgattcaccatctccagagacaattccaagaacacgctgtttctgcaaatgaacagcctgagagtcgaggacacggctgtgtattactgtgcgagagaaactggggagggctggtacttcgatctctggggccgtggcaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 648 - protein, 449 aa, artificial
  4F3 HC
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 649 - DNA, 1341 bp, artificial
  4F7 HC
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctctagtgcctccaccaagggcccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 650 - protein, 446 aa, artificial
  HC
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 651 - DNA, 1368 bp, artificial
  16A4 HC
caggtgcagctgcaggagtcgggcccaggactggcgaagccttcggagaccctgtccctcacctgcactgtctctggtgactccatcactagttactactggagctggatccggcagcccccagggaagggactggagtggattgggtatatctattacagcgggagcaccaattacaacccctccctcaagagtcgagtcaccatatcagtagacacgtccaagaaccagttctccctgaagctgagttctgtgaccgctgcggacacggccgtgtattactgtgcgagagatcaaaggcggatagcagcagctggtacccacttctacggtatggacgtctggggccaagggaccacggtcactgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 652 - protein, 455 aa, artificial
  16A4 HC
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 653 - DNA, 1353 bp, artificial
  16C1 HC
caggtgcagctgcaggagtcgggcccaggactggtgaagccttcggagaccctgtccctcacttgtactgtctctggtggctccatcagtggttactactggagctggatccggcagcccccagggaagggactggagtggattgggtatatctattacattgggagcaccaactacaacccctccctcaagagtcgagtcaccatgtcaatagacacgtccaagaaccagttctccctgacgctgagctctttgaccgctgcggacacggccgtgtatttctgtgcgagagatgggagcagtggctggtaccggtggttcgacccctggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 654 - protein, 450 aa, artificial
  16C1 HC
QVQLQESGPGLVKPSETLSLTCTVSGGSISGYYWSWIRQPPGKGLEWIGYIYYIGSTNYNPSLKSRVTMSIDTSKNQFSLTLSSLTAADTAVYFCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 655 - DNA, 1359 bp, artificial
  17H8 HC
caggtgcagctgcaggagtcgggcccaggactggtgaagccttcggagaccctgtccctcacgtgcactgtctctggtggctccatcaatagttactactggagctggatccggcagcccccagggaagggactggagtggattgggtatatctattacattgggagcaccaactacaacccctccctcaagagtcgcgtcaccatatcagtagacacgtccaagaaccagttctccctgaagctgagctctgtgaccgctgcggacacggccctgtattactgtgcgagagattcccggtatagaagtggctggtacgatgcttttgatatctggggccaagggacaatggtcaccgtctcttcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 656 - protein, 452 aa, artificial
  17H8 HC
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 657 - DNA, 1353 bp, artificial
  19B5 HC
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 658 - protein, 450 aa, artificial
  19B5 HC
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 659 - DNA, 1353 bp, artificial
  20D3 HC
caggtgcagctggtgcagtctggggctgaggtgaagaagcctggggcctcagtgaaggtttcctgcaaggtttctggatacaccttcaccagctactttattcactgggtgcgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 660 - protein, 450 aa, artificial
  20D3 HC
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 661 - DNA, 1353 bp, artificial
  22D1 HC
caggtgcagctggtgcagtctggggctgaggtgaagaagcctggggcctcagtgagggtttcctgcaaggtttctggatacaccttcaccagctactttattcactgggtacgccaggcccctggacaagggcttgagtggatgggaataatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 662 - protein, 450 aa, artificial
  22D1 HC
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 663 - DNA, 1356 bp, artificial
  22G10 HC
gaggtgcaactgttggagtctgggggaggcttggtacagcctggggggtccctgagactctcctgtgcagcctctggattcacctttagcagttatgccatgaactgggtccgccaggctccagggaaggggctggagtgggtctcaactattagtggtggtggtgctaacacatactacgcagactccgtgaagggccggttcaccatctccagtgacaattccaagagcacgctgtatctgcaaatgaacagcctgagagccgcggacacggccgtatatcactgtgcgaaagggggaatggggggatactactacggtatggacgtctggggccaagggaccacggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 664 - protein, 451 aa, artificial
  22G10 HC
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 665 - DNA, 1368 bp, artificial
  23A10 HC
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgctaatgaacagcctgagagccgaggactcggctgtgtattactgtgcgagaagggccggtatacctggaactacgggctactactatggtatggacgtctggggccaagggaccacggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 666 - protein, 455 aa, artificial
  23A10 HC
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 667 - DNA, 1353 bp, artificial
  25F8 HC
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtcttcatggagctgagcagcctgagatctgaggacacggccgtgtattactgtgcgcgagggggaatacagctatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 668 - protein, 450 aa, artificial
  25F8 HC
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 669 - DNA, 1353 bp, artificial
  25G10 HC
caggtgcagctgcaggagtcgggcccaggactggtgaagccttcggagaccctgtccctcacctgcactgtctctggtggctccatcagtggttactactggagctggatccggcagcccccagggaagggactggagtggattgggtatatctattacattgggagcaccaactacaacccctccctcaagagtcgagtcaccatgtcagtagacacgtccaagaaccagttctccctgaagctgagctctgtgaccgctgcggacacggccgtgtattactgtgcgagagatgggagcagtggctggtaccggtggttcgacccctggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 670 - protein, 449 aa, artificial
  25G10 HC
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 671 - DNA, 1353 bp, artificial
  26D1 HC
caggtgcagttggtgcagtctggggctgaggtgaagaagcctggggcctcagtgaaggtttcctgtaaggcatctagatacaccttcaccagctactatatgtcctgggtgcgacaggcccctggacaagggcttgagtggatgggaataatccaccctagtggtggtgacacaacctacgcacagaagttccagggcagagtcaccatgaccggggacacgtccacgagcacagtctacatggagctgagcagcctgagatctgaggacacggccgtgtattactgtgcgagaggggggataaaactatggttacattttgactattggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 672 - protein, 450 aa, artificial
  26D1 HC
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - DNA, 1353 bp, artificial
  26F12 HC
caggtgcagttggtgcagtctggggctgaggtgaagaagcctggggcctcagtgaaggtttcctgcaaggcatctagatacaccttcaccaactactatatgtcctgggtgcgacaggcccctggacaagggcttgagtggatgggaataatcaaccctagtggtggtgactcaacctacgcacagaagttccagggcagactcaccatgaccggggacacgtccacgagcacagtctacatggagctgagcagcctgagatctgaggacacggccgtgtattactgtgcgagaggggggatacaactatggttacattttgactactggggccagggaaccctggtcaccgtctcctcagcttccaccaagggcccatccgtcttccccctggcgccctcctccaagagcacctctgggggcacagcggccctgggctgcctggtcaaggactacttccccgaaccggtgacggtgtcgtggaactcaggggccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagaaagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctatagcaagctcaccgtggacaagagcaggtggcagcaggggaacgtcttctcatgctccgtgatgcatgaggctctgcacaaccactacacgcagaagagcctctccctgtctccgggtaaatga

SEQ ID NO: 674 - protein, 450 aa, artificial
  26F12 HC
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - DNA, 639 bp, artificial
  2G6 LC
tcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggacagcagcactgtggtattcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 676 - protein, 212 aa, artificial
  2G6 LC
SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 677 - DNA, 645 bp, artificial
  4A2 LC
gaaattgtgttgacgcagtctccaggcaccctgtctttgtctccaggggaaagagccaccctctcctgcagggccagtcggaatattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttacagtgtattactgtcagcagtatggtagctcattcactttcggccctgggaccaaagtggatatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 678 - protein, 214 aa, artificial
  4A2 LC
EIVLTQSPGTLSLSPGERATLSCRASRNISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 679 - DNA, 654 bp, artificial
  4A9 LC
cagtctgtgctgacgcagccgccctcagtgtctggggccccaggacagagggtcaccatctcctgcactgggagcagctccaacatcgggacaggttatgctgtacactggtaccagcagtttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 680 - protein, 217 aa, artificial
  4A9 LC
QSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 681 - DNA, 645 bp, artificial
  4B10 LC
gaaattgtattgacgcagtctccaggcaccctgtctttgtctccaggggaaagagccaccctctcctgcagggccagtcagagtgttagcaacacctacttagcctggtaccatcagagacctggccaggctcccaggctcctcatctatggtgcatccagcagggccactggcatcccagacagattcagtggcagtgggtctgggacagacttcgctctcaccatcagcagtctggagcctgaagattttgcagtgtattactgtcagcagtacagtaactcgtggacgttcggccaagggaccaaggtggaaatcaaacgaactgtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 682 - protein, 214 aa, artificial
  4B10 LC
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 683 - DNA, 645 bp, artificial
  4F3 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggaacctgaggattttgcagtgtattactgtcagcagtatggtagctcgtggacgttcggccaagggaccaaggtggaaatcaaacgtacggtggctgcaccatctgtcttcatcttcccgccatctgatgagcagttgaaatctggaactgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 684 - protein, 214 aa, artificial
  4F3 LC
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 685 - DNA, 654 bp, artificial
  4F7 LC
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtcctaggtcagcccaaggccaaccccactgtcactctgttcccgccctcctctgaggagctccaagccaacaaggccacactagtgtgtctgatcagtgacttctacccgggagctgtgacagtggcctggaaggcagatggcagccccgtcaaggcgggagtggagaccaccaaaccctccaaacagagcaacaacaagtacgcggccagcagctacctgagcctgacgcccgagcagtggaagtcccacagaagctacagctgccaggtcacgcatgaagggagcaccgtggagaagacagtggcccctacagaatgttcatga

SEQ ID NO: 686 - protein, 217 aa, artificial
  4F7 LC
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 687 - DNA, 648 bp, artificial
  16A4 LC
gaaattgtgttgacgcagtctccaggcaccctgtctttgtctccaggggaaagagccaccctctcctgcagggccagtcagagtgttagcagcagttatttagcctggtaccagcagaaacctggccaggctcccaggctcctcatctatggtacatccagcagggccactggcatcccagacaggttcagtggcagtgggtctgggacagacttcactctcaccatcagcagactggagcctgaagattttgcagtgtattattgtcagcagtacggtagctcacctttcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 688 - protein, 215 aa, artificial
  16A4 LC
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 689 - DNA, 648 bp, artificial
  16C1 LC
gaaattgtgttgacgcagtctccaggcaccctgtctttgtctccaggggaaagagccaccctctcctgcagggccagccagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcggactggagcctgaagattttgcagtgtatcactgtcagcagtatggtaactcaccgctcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 690 - protein, 215 aa, artificial
  16C1 LC
EIVLTQSPGTLSLSPGERATLSCRASQSVSSSYLAWYQQKPGQAPRLLIFGASSRATGIPDRFSGSGSGTDFTLTISGLEPEDFAVYHCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 691 - DNA, 648 bp, artificial
  17H8 LC
gacattgtattgacgcagtctccaggcaccctgtctttgtctccaggggaaagagccaccctctcctgcagggccagtcagagtgttgccggcagctacctagcctggtaccagcagaaacctggccaggctcccaggctcctcatctctggtgcatccagcagggccactggcatcccagacaggttcagtggcagtgggtctgggacagacttcactctcaccatcagcagactggagcctgaagattttgcagtgtattactgtcagcagtatggtaaatcaccgatcaccttcggccaagggacacgactggagatgaaaggaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 692 - protein, 215 aa, artificial
  17H8 LC
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 693 - DNA, 651 bp, artificial
  19B5 LC
cagtctgcgctgactcagccaccctcaacgactgggacccccgggcagagggtcaccatctcttgttctggaagcaggtccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgcgcaacatgggatgacagtatgaatggttgggtgttcggcggagggaccaaactgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 694 - protein, 216 aa, artificial
  19B5 LC
QSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 695 - DNA, 651 bp, artificial
  20D3 LC
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 696 - protein, 216 aa, artificial
  20D3 LC
QSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 697 - DNA, 651 bp, artificial
  22D1 LC
cagtctgcgctgactcagccaccctcagcgactgggacccccgggcagagggtcaccatctcttgttctggaagcagctccaacatcggaagcaattttgtaaactggtacaagcagctcccaggaacggcccccaaagtcctcatctatactaataatcagcggccctcaggggtccctgaccgattctctggctccaagtctggcacctcagcctccctggccatcagtgggctccagtctgaggatgagtctgattattactgtgcaacatgggatgacagtatgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 698 - protein, 216 aa, artificial
  22D1 LC
QSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 699 - DNA, 645 bp, artificial
  22G10 LC
gaaatagtgatgacgcagtctccagtcaccctgtctctgtctctaggggaaagagccaccctctcctgcagggccagtcagagtattagcagcaacttagcctggttccagcagaaacctggccaggctcccagactcctcatctatggtgcatttaccagggccactggtatcccagccagggtcagtggcagtgggtctgggacagagttcactctcaccatcagcagcctgcagtctgaagattttgcagtttattactgtcagcagtataattactggccgctcactttcggcggagggaccaaggtggagatcaagcgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 700 - protein, 214 aa, artificial
  22G10 LC
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 701 - DNA, 639 bp, artificial
  23A10 LC
tcctatgagctgactcagccaccctcagtgtccgtgtccccaggacagacagccagcatcacctgctctggagatagattgggggagaaatatgtttgctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 702 - protein, 212 aa, artificial
  23A10 LC
SYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 703 - DNA, 651 bp, artificial
  25F8 LC
cagtctgcgctgactcagccaccctcagcgactgggacccccgggcagagggtcaccatctcttgttctggaagcagctccaacatcggaaggaattttgtaaactggtataagcagctcccaggaacggcccccaaagtcctcatttatactaataatcagcggccctcaggggtccctgaccgattctctggctccaagtctggcacctcagcctccctggccatcagtgggctccagtctgaggatgagtctgattattactgtgcagcatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 704 - protein, 216 aa, artificial
  25F8 LC
QSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 705 - DNA, 648 bp, artificial
  25G10 LC
gaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctttggtgcatccagcagggccactggcatcccagacaggttcagtggcagtgggtctgggacagacttcactctcaccatcagcagactggagcctgaagattttgcagtgtatcactgtcagcagtatggtaactcaccgctcactttcggcggagggaccaaggtggagatcaaacgaactgtggctgcaccatctgtcttcatcttcccgccatctgatgagcagttgaaatctggtaccgcctctgttgtgtgcctgctgaataacttctatcccagagaggccaaagtacagtggaaggtggataacgccctccaatcgggtaactcccaggagagtgtcacagagcaggacagcaaggacagcacctacagcctcagcagcaccctgacgctgagcaaagcagactacgagaaacacaaagtctacgcctgcgaagtcacccatcagggcctgagctcgcccgtcacaaagagcttcaacaggggagagtgttga

SEQ ID NO: 706 - protein, 215 aa, artificial
  25G10 LC
EIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 707 - DNA, 651 bp, artificial
  26D1 LC
cactctgtgctgactcagtcaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 708 - protein, 216 aa, artificial
  26D1 LC
HSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 709 - DNA, 651 bp, artificial
  26F12 LC
cagtctgtgctgactcagtcaccctcagcgtctgggacccccgggcagaaggtcaccatctcttgttctggaagccgctccaacatcggaagtaattttgtaaactggtaccagcagctcccaggaacggcccccaaactcctcatctatactaattatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtcctaggtcagcccaaggctgccccctcggtcactctgttcccaccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttcatga

SEQ ID NO: 710 - protein, 216 aa, artificial
  26F12 LC
QSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 711 - protein, 449 aa, artificial; identical to SEQ ID NO: 648
  [hu anti-<huCDH19> 4F3 VH]::huIgG1z

SEQ ID NO: 712 - protein, 446 aa, artificial; identical to SEQ ID NO: 644
  HC [hu anti-<huCDH19> 4A9 VH]::huIgG1z

SEQ ID NO: 713 - protein, 449 aa, artificial; identical to SEQ ID NO: 646
  HC [hu anti-<huCDH19> 4B10 VH]::huIgG1z

SEQ ID NO: 714 - protein, 452 aa, artificial; identical to SEQ ID NO: 656
  HC [hu anti-<huCDH19> 17H8.2 VH]::huIgG1z

SEQ ID NO: 715 - protein, 450 aa, artificial; identical to SEQ ID NO: 654
  HC [hu anti-<huCDH19> 16C1.1 VH]::huIgG1z

SEQ ID NO: 716 - protein, 455 aa, artificial; identical to SEQ ID NO: 652
  HC [hu anti-<huCDH19> 16A4.1 VH]::huIgG1z

SEQ ID NO: 717 - protein, 451 aa, artificial; identical to SEQ ID NO: 664
  HC [hu anti-<huCDH19> 22G10.1 VH]::huIgG1z

SEQ ID NO: 718 - protein, 450 aa, artificial; identical to SEQ ID NO: 660
  HC [hu anti-<huCDH19> 20D3.1 VH]::huIgG1z

SEQ ID NO: 719 - protein, 450 aa, artificial; identical to SEQ ID NO: 662
  HC [hu anti-<huCDH19> 22D1.1 VH]::huIgG1z

SEQ ID NO: 720 - protein, 450 aa, artificial; identical to SEQ ID NO: 668
  HC [hu anti-<huCDH19> 25F8.1 VH]::huIgG1z

SEQ ID NO: 721 - protein, 450 aa, artificial; identical to SEQ ID NO: 674
  HC [hu anti-<huCDH19> 26F12.1 VH]::huIgG1z

SEQ ID NO: 722 - protein, 450 aa, artificial; identical to SEQ ID NO: 672
  HC [hu anti-<huCDH19> 26D1.1 VH]::huIgG1z

SEQ ID NO: 723 - protein, 450 aa, artificial
  HC [hu anti-<huCDH19> 25G10.1 VH]::huIgG1z
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 450 aa, artificial; identical to SEQ ID NO: 658
  HC [hu anti-<huCDH19> 19B5.1 VH]::huIgG1z

SEQ ID NO: 725 - protein, 450 aa, artificial; identical to SEQ ID NO: 642
  HC [hu anti-<huCDH19> 4A2 VH]::huIgG1z

SEQ ID NO: 726 - protein, 450 aa, artificial
  HC [hu anti-<huCDH19> 4A2 (1-472)(Q17E,H47P) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 727 - protein, 450 aa, artificial; identical to SEQ ID NO: 642
  HC [hu anti-<huCDH19> 4A2 VH]::huIgG1z

SEQ ID NO: 728 - protein, 450 aa, artificial; identical to SEQ ID NO: 726
  HC [hu anti-<huCDH19> 4A2 (1-472)(Q17E,H47P) VH]::huIgG1z

SEQ ID NO: 729 - protein, 450 aa, artificial
  HC [hu anti-<huCDH19> 4A2 (1-472)(Q17E,H47P,D111E) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCAREGSSGWYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 730 - protein, 450 aa, artificial
  HC [hu anti-<huCDH19> 4A2 (1-472)(Q17E,H47P,D111E,W134Y) VH]::huIgG1z
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCAREGSSGYYFQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 450 aa, artificial; identical to SEQ ID NO: 642
  HC [hu anti-<huCDH19> 4A2 VH]::huIgG1z

SEQ ID NO: 732 - protein, 449 aa, artificial
  HC [hu anti-<huCDH19> 4F3 (1-471)(R17G) VH]::huIgG1z
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 733 - protein, 449 aa, artificial
  HC [hu anti-<huCDH19> 4F3 (1-471)(R17G,T47A) VH]::huIgG1z
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 734 - protein, 449 aa, artificial
  HC [hu anti-<huCDH19> 4F3 (1-471)(R17G,T47A,R141Q) VH]::huIgG1z
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 735 - protein, 449 aa, artificial
  HC [hu anti-<huCDH19> 4F3 (1-471)(R17G,T47A,D61E,D72E,R141Q) VH]::huIgG1z
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 736 - protein, 449 aa, artificial
  HC [hu anti-<huCDH19> 4F3 (1-471)(R17G,T47A,D61E,D72E,W134Y,R141Q) VH]::huIgG1z
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGYYFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 737 - protein, 455 aa, artificial
  HC [hu anti-<huCDH19> 2G6 (1-477)(R17G,D61E,D72E,K94N) VH]::huIgG1z
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 738 - protein, 450 aa, artificial; identical to SEQ ID NO: 654
  HC [hu anti-<huCDH19> 16C1.1 VH]::huIgG1z

SEQ ID NO: 739 - protein, 450 aa, artificial
  HC [hu anti-<huCDH19> 16C1.1 (1-469)(T92K) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 740 - protein, 450 aa, artificial
  HC [hu anti-<huCDH19> 16C1.1 (1-469)(T92K,D109E) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCAREGSSGWYRWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 741 - protein, 450 aa, artificial
  HC [hu anti-<huCDH19> 16C1.1 (1-469)(T92K,W132Y,W135Y) VH]::huIgG1z
QVQLQESGPGLVKPSETLSLTCTVSGGSISGYYWSWIRQPPGKGLEWIGYIYYIGSTNYNPSLKSRVTMSIDTSKNQFSLKLSSLTAADTAVYFCARDGSSGYYRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 742 - protein, 450 aa, artificial; identical to SEQ ID NO: 739
  HC [hu anti-<huCDH19> 16C1.1 (1-469)(T92K) VH]::huIgG1z

SEQ ID NO: 743 - protein, 452 aa, artificial; identical to SEQ ID NO: 656
  HC [hu anti-<huCDH19> 17H8.2 VH]::huIgG1z

SEQ ID NO: 744 - protein, 452 aa, artificial
  HC [hu anti-<huCDH19> 17H8.2 (1-471)(D109E) VH]::huIgG1z
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGWYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 745 - protein, 452 aa, artificial
  HC [hu anti-<huCDH19> 17H8.2 (1-471)(D109E,W132Y) VH]::huIgG1z
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARESRYRSGYYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 746 - protein, 452 aa, artificial; identical to SEQ ID NO: 744
  HC [hu anti-<huCDH19> 17H8.2 (1-471)(D109E) VH]::huIgG1z

SEQ ID NO: 747 - protein, 446 aa, artificial; identical to SEQ ID NO: 650
  HC [hu anti-<huCDH19> 4F7 VH]::huIgG1z

SEQ ID NO: 748 - protein, 446 aa, artificial; identical to SEQ ID NO: 650
  HC [hu anti-<huCDH19> 4F7 VH]::huIgG1z

SEQ ID NO: 749 - protein, 446 aa, artificial
  HC [hu anti-<huCDH19> 4F7 (1-468)(W113Y) VH]::huIgG1z
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNYAFHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 750 - protein, 449 aa, artificial
  HC [hu anti-<huCDH19> 4B10 (1-471)(R17G,D61E,D72E,W134Y) VH]::huIgG1z
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDYSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 751 - protein, 449 aa, artificial; identical to SEQ ID NO: 646
  HC [hu anti-<huCDH19> 4B10 VH]::huIgG1z

SEQ ID NO: 752 - protein, 449 aa, artificial
  HC [hu anti-<huCDH19> 4B10 (1-471)(R17G) VH]::huIgG1z
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 753 - protein, 449 aa, artificial
  HC [hu anti-<huCDH19> 4B10 (1-471)(R17G,D61E,D72E) VH]::huIgG1z
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 754 - protein, 446 aa, artificial; identical to SEQ ID NO: 644
  HC [hu anti-<huCDH19> 4A9 VH]::huIgG1z

SEQ ID NO: 755 - protein, 446 aa, artificial
  HC [hu anti-<huCDH19> 4A9 (1-468)(F55I,A56G) VH]::huIgG1z
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 756 - protein, 446 aa, artificial; identical to SEQ ID NO: 755
  HC [hu anti-<huCDH19> 4A9 (1-468)(F55I,A56G) VH]::huIgG1z

SEQ ID NO: 757 - protein, 446 aa, artificial
  HC [hu anti-<huCDH19> 4A9 (1-468)(F55I,A56G,W113Y) VH]::huIgG1z
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNYAFHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 758 - protein, 450 aa, artificial; identical to SEQ ID NO: 660
  HC [hu anti-<huCDH19> 20D3.1 VH]::huIgG1z

SEQ ID NO: 759 - protein, 450 aa, artificial; identical to SEQ ID NO: 660
  HC [hu anti-<huCDH19> 20D3.1 VH]::huIgG1z

SEQ ID NO: 760 - protein, 450 aa, artificial
  HC [hu anti-<huCDH19> 20D3.1 (1-469)(W133Y) VH]::huIgG1z
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 761 - protein, 450 aa, artificial; identical to SEQ ID NO: 760
  HC [hu anti-<huCDH19> 20D3.1 (1-469)(W133Y) VH]::huIgG1z

SEQ ID NO: 762 - protein, 450 aa, artificial; identical to SEQ ID NO: 760
  HC [hu anti-<huCDH19> 20D3.1 (1-469)(W133Y) VH]::huIgG1z

SEQ ID NO: 763 - protein, 451 aa, artificial
  HC [hu anti-<huCDH19> 22G10.1 (1-470)(S82R,A99E) VH]::huIgG1z
EVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 764 - protein, 451 aa, artificial
  HC [hu anti-<huCDH19> 22G10.1 (1-470)(A99E,H105Y) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAEDTAVYYCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 765 - protein, 451 aa, artificial
  HC [hu anti-<huCDH19> 22G10.1 (1-470)(A99E) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 766 - protein, 451 aa, artificial; identical to SEQ ID NO: 765
  HC [hu anti-<huCDH19> 22G10.1 (1-470)(A99E) VH]::huIgG1z

SEQ ID NO: 767 - protein, 451 aa, artificial
  HC [hu anti-<huCDH19> 22G10.1 (1-470)(D72E,A99E) VH]::huIgG1z
EVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 768 - protein, 451 aa, artificial
  HC [hu anti-<huCDH19> 22G10.1 (1-470)(H105Y) VH]::huIgG1z
EVQLLESGGGLVQPGGSLRLSCAASGFTFSSYAMNWVRQAPGKGLEWVSTISGGGANTYYADSVKGRFTISSDNSKSTLYLQMNSLRAADTAVYYCAKGGMGGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 769 - protein, 455 aa, artificial
  HC [hu anti-<huCDH19> 16A4.1 (1-474)(T144L) VH]::huIgG1z
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 770 - protein, 450 aa, artificial; identical to SEQ ID NO: 658
  HC [hu anti-<huCDH19> 19B5.1 VH]::huIgG1z

SEQ ID NO: 771 - protein, 450 aa, artificial
  HC [hu anti-<huCDH19> 19B5.1 (1-469)(W133Y) VH]::huIgG1z
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 772 - protein, 450 aa, artificial; identical to SEQ ID NO: 658
  HC [hu anti-<huCDH19> 19B5.1 VH]::huIgG1z

SEQ ID NO: 773 - protein, 450 aa, artificial; identical to SEQ ID NO: 658
  HC [hu anti-<huCDH19> 19B5.1 VH]::huIgG1z

SEQ ID NO: 774 - protein, 450 aa, artificial; identical to SEQ ID NO: 771
  HC [hu anti-<huCDH19> 19B5.1 (1-469)(W133Y) VH]::huIgG1z

SEQ ID NO: 775 - protein, 455 aa, artificial
  HC [hu anti-<huCDH19> 23A10.3 (1-474)(L92Q) VH]::huIgG1z
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 776 - protein, 455 aa, artificial
  HC [hu anti-<huCDH19> 23A10.3 (1-474)(R17G,L92Q) VH]::huIgG1z
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 777 - protein, 455 aa, artificial
  HC [hu anti-<huCDH19> 23A10.3 (1-474)(R17G,D61E,D72E,L92Q) VH]::huIgG1z
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 778 - protein, 455 aa, artificial; identical to SEQ ID NO: 666
  HC [hu anti-<huCDH19> 23A10.3 VH]::huIgG1z

SEQ ID NO: 779 - protein, 450 aa, artificial; identical to SEQ ID NO: 723
  HC [hu anti-<huCDH19> 25G10.1 VH]::huIgG1z

SEQ ID NO: 780 - protein, 450 aa, artificial
  HC [hu anti-<huCDH19> 25G10.1 (1-469)(D109E,W132Y,W135Y) VH]::huIgG1z
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCAREGSSGYYRYFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 781 - protein, 450 aa, artificial; identical to SEQ ID NO: 672
  HC [hu anti-<huCDH19> 26D1.1 VH]::huIgG1z

SEQ ID NO: 782 - protein, 450 aa, artificial; identical to SEQ ID NO: 672
  HC [hu anti-<huCDH19> 26D1.1 VH]::huIgG1z

SEQ ID NO: 783 - protein, 450 aa, artificial; identical to SEQ ID NO: 672
  HC [hu anti-<huCDH19> 26D1.1 VH]::huIgG1z

SEQ ID NO: 784 - protein, 450 aa, artificial; identical to SEQ ID NO: 672
  HC [hu anti-<huCDH19> 26D1.1 VH]::huIgG1z

SEQ ID NO: 785 - protein, 450 aa, artificial
  HC [hu anti-<huCDH19> 26D1.1 (1-469)(W133Y) VH]::huIgG1z
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 786 - protein, 450 aa, artificial
  HC [hu anti-<huCDH19> 26D1.1 (1-469)(R27G,G82R) VH]::huIgG1z
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 787 - protein, 450 aa, artificial; identical to SEQ ID NO: 674
  HC [hu anti-<huCDH19> 26F12.1 VH]::huIgG1z

SEQ ID NO: 788 - protein, 450 aa, artificial; identical to SEQ ID NO: 674
  HC [hu anti-<huCDH19> 26F12.1 VH]::huIgG1z

SEQ ID NO: 789 - protein, 450 aa, artificial
  HC [hu anti-<huCDH19> 26F12.1 (1-469)(W133Y) VH]::huIgG1z
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 790 - protein, 450 aa, artificial; identical to SEQ ID NO: 789
  HC [hu anti-<huCDH19> 26F12.1 (1-469)(W133Y) VH]::huIgG1z

SEQ ID NO: 791 - protein, 450 aa, artificial; identical to SEQ ID NO: 668
  HC [hu anti-<huCDH19> 25F8.1 VH]::huIgG1z

SEQ ID NO: 792 - protein, 450 aa, artificial; identical to SEQ ID NO: 668
  HC [hu anti-<huCDH19> 25F8.1 VH]::huIgG1z

SEQ ID NO: 793 - protein, 450 aa, artificial
  HC [hu anti-<huCDH19> 25F8.1 (1-469)(F90Y) VH]::huIgG1z
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 794 - protein, 450 aa, artificial; identical to SEQ ID NO: 793
  HC [hu anti-<huCDH19> 25F8.1 (1-469)(F90Y) VH]::huIgG1z

SEQ ID NO: 795 - protein, 450 aa, artificial
  HC [hu anti-<huCDH19> 25F8.1 (1-469)(F90Y,W133Y) VH]::huIgG1z
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLYLHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 796 - protein, 450 aa, artificial; identical to SEQ ID NO: 662
  HC [hu anti-<huCDH19> 22D1.1 VH]::huIgG1z

SEQ ID NO: 797 - protein, 450 aa, artificial; identical to SEQ ID NO: 662
  HC [hu anti-<huCDH19> 22D1.1 VH]::huIgG1z

SEQ ID NO: 798 - protein, 450 aa, artificial
  hu anti-<huCDH19> 22D1.1 (1-469)(W133Y) VH]::huIgG1z
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLYLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 799 - protein, 450 aa, artificial; identical to SEQ ID NO: 798
  HC [hu anti-<huCDH19> 22D1.1 (1-469)(W133Y) VH]::huIgG1z

SEQ ID NO: 800 - protein, 450 aa, artificial
  HC [hu anti-<huCDH19> 22D1.1 (1-469)(F90Y) VH]::huIgG1z
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 801 - protein, 446 aa, artificial; identical to SEQ ID NO: 650
  HC [hu anti-<huCDH19> 4F7 VH]::huIgG1z

SEQ ID NO: 802 - protein, 455 aa, artificial; identical to SEQ ID NO: 640
  HC [hu anti-<huCDH19> 2G6 VH]::huIgG1z

SEQ ID NO: 803 - protein, 455 aa, artificial
  HC [hu anti-<huCDH19> 2G6 (1-477)(R17G,K94N) VH]::huIgG1z
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 804 - protein, 455 aa, artificial
  HC [hu anti-<huCDH19> 2G6 (1-477)(D61E,D72E) VH]::huIgG1z
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 805 - protein, 455 aa, artificial
  HC [hu anti-<huCDH19> 2G6 (1-477)(R17G) VH]::huIgG1z
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 806 - protein, 214 aa, artificial; identical to SEQ ID NO: 684
  LC [hu anti-<huCDH19> 4F3 VL]::huKLC

SEQ ID NO: 807 - protein, 217 aa, artificial; identical to SEQ ID NO: 680
  LC [hu anti-<huCDH19> 4A9 VL]::huLLC-C1

SEQ ID NO: 808 - protein, 214 aa, artificial; identical to SEQ ID NO: 682
  LC [hu anti-<huCDH19> 4B10 VL]::huKLC

SEQ ID NO: 809 - protein, 215 aa, artificial; identical to SEQ ID NO: 692
  LC [hu anti-<huCDH19> 17H8.2 VL]::huKLC

SEQ ID NO: 810 - protein, 215 aa, artificial; identical to SEQ ID NO: 690
  LC [hu anti-<huCDH19> 16C1.1 VL]::huKLC

SEQ ID NO: 811 - protein, 215 aa, artificial; identical to SEQ ID NO: 688
  LC [hu anti-<huCDH19> 16A4.1 VL]::huKLC

SEQ ID NO: 812 - protein, 214 aa, artificial; identical to SEQ ID NO: 700
  LC [hu anti-<huCDH19> 22G10.1 VL]::huKLC

SEQ ID NO: 813 - protein, 216 aa, artificial; identical to SEQ ID NO: 696
  LC [hu anti-<huCDH19> 20D3.1 VL]::huLLC-C2

SEQ ID NO: 814 - protein, 216 aa, artificial; identical to SEQ ID NO: 698
  LC [hu anti-<huCDH19> 22D1.1 VL]::huLLC-C2

SEQ ID NO: 815 - protein, 216 aa, artificial; identical to SEQ ID NO: 704
  LC [hu anti-<huCDH19> 25F8.1 VL]::huLLC-C2

SEQ ID NO: 816 - protein, 216 aa, artificial; identical to SEQ ID NO: 710
  LC [hu anti-<huCDH19> 26F12.1 VL]::huLLC-C2

SEQ ID NO: 817 - protein, 216 aa, artificial; identical to SEQ ID NO: 708
  LC [hu anti-<huCDH19> 26D1.1 VL]::huLLC-C2

SEQ ID NO: 818 - protein, 215 aa, artificial; identical to SEQ ID NO: 706
  LC [hu anti-<huCDH19> 25G10.1 VL]::huKLC

SEQ ID NO: 819 - protein, 216 aa, artificial; identical to SEQ ID NO: 694
  LC [hu anti-<huCDH19> 19B5.1 VL]::huLLC-C2

SEQ ID NO: 820 - protein, 214 aa, artificial
  LC [hu anti-<huCDH19> 4A2 (1-236)(N30Q) VL]::huKLC
EIVLTQSPGTLSLSPGERATLSCRASRQISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 821 - protein, 214 aa, artificial
  LC [hu anti-<huCDH19> 4A2 (1-236)(N30Q,T102A,P141Q) VL]::huKLC
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 822 - protein, 214 aa, artificial
  LC [hu anti-<huCDH19> 4A2 (1-236)(N30Q,T102A) VL]::huKLC
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 823 - protein, 214 aa, artificial; identical to SEQ ID NO: 822
  LC [hu anti-<huCDH19> 4A2 (1-236)(N30Q,T102A) VL]::huKLC

SEQ ID NO: 824 - protein, 214 aa, artificial; identical to SEQ ID NO: 821
  LC [hu anti-<huCDH19> 4A2 (1-236)(N30Q,T102A,P141Q) VL]::huKLC

SEQ ID NO: 825 - protein, 214 aa, artificial; identical to SEQ ID NO: 821
  LC [hu anti-<huCDH19> 4A2 (1-236)(N30Q,T102A,P141Q) VL]::huKLC

SEQ ID NO: 826 - protein, 214 aa, artificial
  LC [hu anti-<huCDH19> 4A2 (1-236)(R29Q,N30S) VL]::huKLC
EIVLTQSPGTLSLSPGERATLSCRASQSISSSYLAWYQQKPGQAPRLLIYGPSSRATGIPDRFSGSGSGTDFTLTISRLEPEDFTVYYCQQYGSSFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 827 - protein, 214 aa, artificial; identical to SEQ ID NO: 684
  LC [hu anti-<huCDH19> 4F3 VL]::huKLC

SEQ ID NO: 828 - protein, 214 aa, artificial; identical to SEQ ID NO: 684
  LC [hu anti-<huCDH19> 4F3 VL]::huKLC

SEQ ID NO: 829 - protein, 214 aa, artificial; identical to SEQ ID NO: 684
  LC [hu anti-<huCDH19> 4F3 VL]::huKLC

SEQ ID NO: 830 - protein, 214 aa, artificial; identical to SEQ ID NO: 684
  LC [hu anti-<huCDH19> 4F3 VL]::huKLC

SEQ ID NO: 831 - protein, 214 aa, artificial; identical to SEQ ID NO: 684
  LC [hu anti-<huCDH19> 4F3 VL]::huKLC

SEQ ID NO: 832 - protein, 212 aa, artificial
  LC [hu anti-<huCDH19> 2G6 (1-234)(C42S,D110E) VL]::huLLC-C1
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 833 - protein, 215 aa, artificial
  LC [hu anti-<huCDH19> 16C1.1 (1-235)(H105Y) VL]::huKLC
EIVLTQSPGTLSLSPGERATLSCRASQSVSSSYLAWYQQKPGQAPRLLIFGASSRATGIPDRFSGSGSGTDFTLTISGLEPEDFAVYYCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 834 - protein, 215 aa, artificial; identical to SEQ ID NO: 833
  LC [hu anti-<huCDH19> 16C1.1 (1-235)(H105Y) VL]::huKLC

SEQ ID NO: 835 - protein, 215 aa, artificial; identical to SEQ ID NO: 833
  LC [hu anti-<huCDH19> 16C1.1 (1-235)(H105Y) VL]::huKLC

SEQ ID NO: 836 - protein, 215 aa, artificial; identical to SEQ ID NO: 833
  LC [hu anti-<huCDH19> 16C1.1 (1-235)(H105Y) VL]::huKLC

SEQ ID NO: 837 - protein, 215 aa, artificial
  LC [hu anti-<huCDH19> 16C1.1 (1-235)(G95R,H105Y,G141Q) VL]::huKLC
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 838 - protein, 215 aa, artificial
  LC [hu anti-<huCDH19> 17H8.2 (1-235)(G149R) VL]::huKLC
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 839 - protein, 215 aa, artificial; identical to SEQ ID NO: 838
  LC [hu anti-<huCDH19> 17H8.2 (1-235)(G149R) VL]::huKLC

SEQ ID NO: 840 - protein, 215 aa, artificial; identical to SEQ ID NO: 838
  LC [hu anti-<huCDH19> 17H8.2 (1-235)(G149R) VL]::huKLC

SEQ ID NO: 841 - protein, 215 aa, artificial
  LC [hu anti-<huCDH19> 17H8.2 (1-235)(S57Y,G149R) VL]::huKLC
DIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 842 - protein, 217 aa, artificial
  LC [hu anti-<huCDH19> 4F7 (1-239)(H57Y) VL]::huLLC-C2
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 843 - protein, 217 aa, artificial
  LC [hu anti-<huCDH19> 4F7 (1-239)(H57Y,D110E) VL]::huLLC-C2
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 844 - protein, 217 aa, artificial
  LC [hu anti-<huCDH19> 4F7 (1-239)(D110E) VL]::huLLC-C2
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYESSLSGWVFGGGTRLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 845 - protein, 214 aa, artificial
  LC [hu anti-<huCDH19> 4B10 (1-236)(H45Q,A90T) VL]::huKLC
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 846 - protein, 214 aa, artificial; identical to SEQ ID NO: 845
  LC [hu anti-<huCDH19> 4B10 (1-236)(H45Q,A90T) VL]::huKLC

SEQ ID NO: 847 - protein, 214 aa, artificial; identical to SEQ ID NO: 845
  LC [hu anti-<huCDH19> 4B10 (1-236)(H45Q,A90T) VL]::huKLC

SEQ ID NO: 848 - protein, 214 aa, artificial; identical to SEQ ID NO: 845
  LC [hu anti-<huCDH19> 4B10 (1-236)(H45Q,A90T) VL]::huKLC

SEQ ID NO: 849 - protein, 217 aa, artificial
  LC [hu anti-<huCDH19> 4A9 (1-239)(F47L) VL]::huLLC-C1
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 850 - protein, 217 aa, artificial; identical to SEQ ID NO: 849
  LC [hu anti-<huCDH19> 4A9 (1-239)(F47L) VL]::huLLC-C1

SEQ ID NO: 851 - protein, 217 aa, artificial
  LC [hu anti-<huCDH19> 4A9 (1-239)(F47L,D110E) VL]::huLLC-C1
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYESRLSGWVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 852 - protein, 217 aa, artificial; identical to SEQ ID NO: 851
  LC [hu anti-<huCDH19> 4A9 (1-239)(F47L,D110E) VL]::huLLC-C1

SEQ ID NO: 853 - protein, 216 aa, artificial
  LC [hu anti-<huCDH19> 20D3.1 (1-235)(S102A) VL]::huLLC-C2
QSALTQPPSATGTPGQRVTISCSGSSSNIGSNFVNWYKQLPGTAPKVLIYTNNQRPSGVPDRFSGSKSGTSASLAISGLQSEDEADYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 854 - protein, 216 aa, artificial
  LC [hu anti-<huCDH19> 20D3.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 855 - protein, 216 aa, artificial; identical to SEQ ID NO: 854
  LC [hu anti-<huCDH19> 20D3.1 (1-235)(K45Q,S102A) VL]::huLLC-C2

SEQ ID NO: 856 - protein, 216 aa, artificial
  LC [hu anti-<huCDH19> 20D3.1 (1-235)(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 857 - protein, 216 aa, artificial
  LC [hu anti-<huCDH19> 20D3.1 (1-235)(W109Y) VL]::huLLC-C2
QSALTQPPSATGTPGQRVTISCSGSSSNIGSNFVNWYKQLPGTAPKVLIYTNNQRPSGVPDRFSGSKSGTSASLAISGLQSEDESDYYCATYDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 858 - protein, 214 aa, artificial; identical to SEQ ID NO: 700
  LC [hu anti-<huCDH19> 22G10.1 VL]::huKLC

SEQ ID NO: 859 - protein, 214 aa, artificial; identical to SEQ ID NO: 700
  LC [hu anti-<huCDH19> 22G10.1 VL]::huKLC

SEQ ID NO: 860 - protein, 214 aa, artificial
  LC [hu anti-<huCDH19> 22G10.1 (1-234)(Q97E,S98P) VL]::huKLC
EIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 861 - protein, 214 aa, artificial
  LC [hu anti-<huCDH19> 22G10.1 (1-234)(V78F,Q97E,S98P) VL]::huKLC
EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 214 aa, artificial; identical to SEQ ID NO: 861
  LC [hu anti-<huCDH19> 22G10.1 (1-234)(V78F,Q97E,S98P) VL]::huKLC

SEQ ID NO: 863 - protein, 214 aa, artificial; identical to SEQ ID NO: 700
  LC [hu anti-<huCDH19> 22G10.1 VL]::huKLC

SEQ ID NO: 864 - protein, 215 aa, artificial
  LC [hu anti-<huCDH19> 16A4.1 (1-235)(G141Q) VL]::huKLC
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 865 - protein, 216 aa, artificial
  LC [hu anti-<huCDH19> 19B5.1 (1-235)(K45Q,S102A) VL]::huLLC-C2
QSALTQPPSTTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 866 - protein, 216 aa, artificial; identical to SEQ ID NO: 865
  LC [hu anti-<huCDH19> 19B5.1 (1-235)(K45Q,S102A) VL]::huLLC-C2

SEQ ID NO: 867 - protein, 216 aa, artificial
  LC [hu anti-<huCDH19> 19B5.1 (1-235)(T11V,K45Q,S102A) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 868 - protein, 216 aa, artificial
  LC [hu anti-<huCDH19> 19B5.1 (1-235)(T11V,K45Q,S102A,D111E,N135Q) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 869 - protein, 216 aa, artificial
  LC [hu anti-<huCDH19> 19B5.1 (1-235)(T11V,K45Q,S102A,W109Y,D111E,N135Q) VL]::huLLC-C2
QSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 870 - protein, 212 aa, artificial
  LC [hu anti-<huCDH19> 23A10.3 (1-231)(C42S) VL]::huLLC-C2
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 871 - protein, 212 aa, artificial; identical to SEQ ID NO: 870
  LC [hu anti-<huCDH19> 23A10.3 (1-231)(C42S) VL]::huLLC-C2

SEQ ID NO: 872 - protein, 212 aa, artificial
  LC [hu anti-<huCDH19> 23A10.3 (1-231)(C42S,D110E) VL]::huLLC-C2
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 873 - protein, 212 aa, artificial
  LC [hu anti-<huCDH19> 23A10.3 (1-231)(C42Y) VL]::huLLC-C2
SYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 874 - protein, 215 aa, artificial
  LC [hu anti-<huCDH19> 25G10.1 (1-235)(H105Y) VL]::huKLC
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 875 - protein, 215 aa, artificial; identical to SEQ ID NO: 874
  LC [hu anti-<huCDH19> 25G10.1 (1-235)(H105Y) VL]::huKLC

SEQ ID NO: 876 - protein, 216 aa, artificial
  LC [hu anti-<huCDH19> 26D1.1 (1-235)(S7P) VL]::huLLC-C2
HSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 877 - protein, 216 aa, artificial
  LC [hu anti-<huCDH19> 26D1.1 (1-235)(H1Q,S7P) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 878 - protein, 216 aa, artificial
  LC [hu anti-<huCDH19> 26D1.1 (1-235)(H1Q,S7P,W109Y) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 879 - protein, 216 aa, artificial
  LC [hu anti-<huCDH19> 26D1.1 (1-235)(H1Q,S7P,W109Y,D111E,N135Q) VL]::huLLC-C2
QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 880 - protein, 216 aa, artificial; identical to SEQ ID NO: 879
  LC [hu anti-<huCDH19> 26D1.1 (1-235)(H1Q,S7P,W109Y,D111E,N135Q) VL]::huLLC-C2

SEQ ID NO: 881 - protein, 216 aa, artificial; identical to SEQ ID NO: 877
  LC [hu anti-<huCDH19> 26D1.1 (1-235)(H1Q,S7P) VL]::huLLC-C2

SEQ ID NO: 882 - protein, 216 aa, artificial
  LC [hu anti-<huCDH19> 26F12.1 (1-235)(S7P) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 883 - protein, 216 aa, artificial
  LC [hu anti-<huCDH19> 26F12.1 (1-235)(S7P,D111E) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 884 - protein, 216 aa, artificial; identical to SEQ ID NO: 883
  LC [hu anti-<huCDH19> 26F12.1 (1-235)(S7P,D111E) VL]::huLLC-C2

SEQ ID NO: 885 - protein, 216 aa, artificial
  LC [hu anti-<huCDH19> 26F12.1 (1-235)(S7P,W109Y,D111E,N135Q) VL]::huLLC-C2
QSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 886 - protein, 216 aa, artificial
  LC [hu anti-<huCDH19> 25F8.1 (1-235)(K45Q) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDESDYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 887 - protein, 216 aa, artificial
  LC [hu anti-<huCDH19> 25F8.1 (1-235)(K45Q,S102A) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDDSLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 888 - protein, 216 aa, artificial; identical to SEQ ID NO: 887
  LC [hu anti-<huCDH19> 25F8.1 (1-235)(K45Q,S102A) VL]::huLLC-C2

SEQ ID NO: 889 - protein, 216 aa, artificial
  LC [hu anti-<huCDH19> 25F8.1 (1-235)(K45Q,S102A,D111E) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 890 - protein, 216 aa, artificial
  LC [hu anti-<huCDH19> 25F8.1 (1-235)(K45Q,S102A,D111E,N135Q) VL]::huLLC-C2
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 891 - protein, 216 aa, artificial
  LC [hu anti-<huCDH19> 22D1.1 (1-235)(K45Q,S102A) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 892 - protein, 216 aa, artificial
  LC [hu anti-<huCDH19> 22D1.1 (1-235)(K45Q,S102A,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATWDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 893 - protein, 216 aa, artificial
  LC [hu anti-<huCDH19> 22D1.1 (1-235)(K45Q,S102A,W109Y,D111E,N135Q) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 894 - protein, 216 aa, artificial
  LC [hu anti-<huCDH19> 22D1.1 (1-235)(K45Q,S102A,W109Y) VL]::huLLC-C2
QSALTQPPSATGTPGQRVTISCSGSSSNIGSNFVNWYQQLPGTAPKVLIYTNNQRPSGVPDRFSGSKSGTSASLAISGLQSEDEADYYCATYDDSMNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 895 - protein, 216 aa, artificial; identical to SEQ ID NO: 891
  [hu anti-<huCDH19> 22D1.1 (1-235)(K45Q,S102A) VL]::huLLC-C2

SEQ ID NO: 896 - protein, 217 aa, artificial; identical to SEQ ID NO: 686
  LC [hu anti-<huCDH19> 4F7 VL]::huLLC-C1

SEQ ID NO: 897 - protein, 212 aa, artificial
  LC [hu anti-<huCDH19> 2G6 (1-234)(D110E) VL]::huLLC-C1
SYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 898 - protein, 212 aa, artificial; identical to SEQ ID NO: 832
  LC [hu anti-<huCDH19> 2G6 (1-234)(C42S,D110E) VL]::huLLC-C1

SEQ ID NO: 899 - protein, 212 aa, artificial; identical to SEQ ID NO: 832
  LC [hu anti-<huCDH19> 2G6 (1-234)(C42S,D110E) VL]::huLLC-C1

SEQ ID NO: 900 - protein, 212 aa, artificial; identical to SEQ ID NO: 870
  LC [hu anti-<huCDH19> 23A10.3 (1-231)(C42S) VL]::huLLC-C2

SEQ ID NO: 901 - protein, 17 aa, artificial
  14039, 14303 - CDR-H2
FIWYEGSNKYYAESVKD

SEQ ID NO: 902 - protein, 10 aa, artificial
  14027 - CDR-H3
EGSSGWYFQY

SEQ ID NO: 903 - protein, 10 aa, artificial
  CDR-H3
EGSSGYYFQY

SEQ ID NO: 904 - protein, 8 aa, artificial
  14059 - CDR-H3
NYAFHFDF

SEQ ID NO: 905 - protein, 17 aa, artificial
  CDR-H2
VISYEGTNEYYAESVKG

SEQ ID NO: 906 - protein, 10 aa, artificial
  CDR-H3
ERYFDYSFDY

SEQ ID NO: 907 - protein, 17 aa, artificial
  CDR-H2
VIWYEGSNKYYAESVRG

SEQ ID NO: 908 - protein, 10 aa, artificial
  CDR-H3
ETGEGYYFDL

SEQ ID NO: 909 - protein, 8 aa, artificial
  CDR-H3
NYAFHFDY

SEQ ID NO: 910 - protein, 14 aa, artificial
  CDR-H3
ESRYRSGWYDAFDI

SEQ ID NO: 911 - protein, 14 aa, artificial
  CDR-H3
ESRYRSGYYDAFDI

SEQ ID NO: 912 - protein, 12 aa, artificial
  CDR-H3
EGSSGWYRWFDP

SEQ ID NO: 913 - protein, 12 aa, artificial
  CDR-H3
DGSSGYYRYFDP

SEQ ID NO: 914 - protein, 17 aa, artificial
  CDR-H2
TISGGGANTYYAESVKG

SEQ ID NO: 915 - protein, 11 aa, artificial
  CDR-H3
GGIQLYLHFDY

SEQ ID NO: 916 - protein, 11 aa, artificial
  CDR-H3
GGIQLYLHLDY

SEQ ID NO: 917 - protein, 11 aa, artificial
  CDR-H3
GGIQLYLHFDY

SEQ ID NO: 918 - protein, 11 aa, artificial
  CDR-H3
GGIQLYLHFDY

SEQ ID NO: 919 - protein, 11 aa, artificial
  CDR-H3
GGIKLYLHFDY

SEQ ID NO: 920 - protein, 12 aa, artificial
  CDR-H3
EGSSGYYRYFDP

SEQ ID NO: 921 - protein, 17 aa, artificial
  CDR-H2
VIWYEGSNKYYAESVKG

SEQ ID NO: 922 - protein, 11 aa, artificial
  CDR-L1
SGDRLGEKYTS

SEQ ID NO: 923 - protein, 9 aa, artificial
  CDR-L3
QAWESSTVV

SEQ ID NO: 924 - protein, 12 aa, artificial
  CDR-L1
RASRQISSSYLA

SEQ ID NO: 925 - protein, 12 aa, artificial
  CDR-L1
RASQSISSSYLA

SEQ ID NO: 926 - protein, 11 aa, artificial
  CDR-L3
QSYESRLSGWV

SEQ ID NO: 927 - protein, 11 aa, artificial
  CDR-L3
QSYESSLSGWV

SEQ ID NO: 928 - protein, 11 aa, artificial
  CDR-L3
ATWDESLQGWV

SEQ ID NO: 929 - protein, 11 aa, artificial
  CDR-L3
ATYDDSLNGWV

SEQ ID NO: 930 - protein, 11 aa, artificial
  CDR-L3
ATWDESMQGWV

SEQ ID NO: 931 - protein, 11 aa, artificial
  CDR-L3
ATYDESMQGWV

SEQ ID NO: 932 - protein, 11 aa, artificial
  CDR-L3
ATYDDSMNGWV

SEQ ID NO: 933 - protein, 11 aa, artificial
  CDR-L3
AAWDESLNGWV

SEQ ID NO: 934 - protein, 11 aa, artificial
  CDR-L3
AAWDESLQGWV

SEQ ID NO: 935 - protein, 11 aa, artificial
  CDR-L3
AVWDESLNGWV

SEQ ID NO: 936 - protein, 11 aa, artificial
  CDR-L3
AVYDESLQGWV

SEQ ID NO: 937 - protein, 11 aa, artificial
  CDR-L3
AVYDDSLNGWV

SEQ ID NO: 938 - protein, 11 aa, artificial
  CDR-L3
AVYDESLQGWV

SEQ ID NO: 939 - protein, 11 aa, artificial
  CDR-L1
SGDRLGEKYVS

SEQ ID NO: 940 - protein, 9 aa, artificial
  CDR-L3
QAWESSTVV

SEQ ID NO: 941 - protein, 11 aa, artificial
  CDR-L1
SGDRLGEKYVY

SEQ ID NO: 942 - protein, 11 aa, artificial
  CDR-L3
ATWDESMQGWV

SEQ ID NO: 943 - protein, 11 aa, artificial
  CDR-L3
ATYDESMQGWV

SEQ ID NO: 944 - protein, 772 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 945 - DNA, 2319 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 946 - protein, 772 aa, cynomolgus
MNCYLLLPFMLGIPLLWPCLGATENSQTKKVQQPVGSHLRVKRGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 947 - DNA, 2319 bp, cynomolgus
atgaattgttatttactgctgccttttatgttgggaattcctctcctatggccttgtcttggagcaacagaaaactctcaaacaaagaaagtccagcagccagtaggatctcatctgagagtgaagcgtggctgggtgtggaaccaattttttgtaccagaggaaatgaatacgactagtcatcacgttggccggctaagatctgatttagacaatggaaacaattctttccagtacaagcttttgggagctggagctggaagtacttttatcattgatgaaagaacaggtgacatatatgccatagagaagcttgatagagaggagcgatccctctacatcttaagagcccaggtaatagacatcactactggaagggctgtggaacctgagtctgagtttgtcatcaaagtttcggatatcaatgacaatgaaccaaaattcctagatgaaccttatgaggccattgtaccagagatgtctccagaaggaacattagtcatccaggtgacagcaagtgatgctgatgacccttcaagtggtaataatgctcgtctcctctacagcttattacaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacgagtgtattaattaaactttcagatgttaatgacaataagcctatatttaaagaaagtttataccgcctgacggtctctgaatctgcacccactgggacttctataggaacaatcatggcatatgataatgacataggagagaatgcagaaatggattacagcattgaagaggatgattcacagacatttgacattattactaatcatgaaactcaagaaggaatagttatattaaaaaagaaagtgaattttgagcaccagaaccactatggtattagagcaaaagttaaaaaccatcatgttgatgagcagctcatgaaataccacactgaagcttccaccactttcattaagatccaggtggaagatgttgatgagcctcctcttttcctccttccgtattacatatttgaaatttttgaagaaaccccacaaggatcatttgtaggcgtggtgtctgccacagacccagacaataggaaatctcctatcaggtattctattactaggagcaaagtgttcaatatcgatgataatggtacaatcactacaactaactcactggatcgggaaatcagtgcttggtacaacctaagtattacagccacagaaaaatacaatatagagcagatctcttcgatcccagtgtatgtgcaagttcttaatatcaatgatcatgctcctgagttctctcaatactatgagagttatgtttgtgaaaatgcaggctctggtcaggtaattcagactatcagtgcagtggatagagatgaatccatagaagagcaccatttttactttaatctatctgtagaagacactaactcttcaagttttacaatcatagacaatcaagataacacagctgtcattttgactaatagaactggttttaaccttcaagaagagcccatcttctacatctccatcttaattgccgacaatggaatcccgtcacttacaagtacaaacacccttaccatccatgtctgtgactgtgatgacagtgggagcacacagacctgccagtaccaggagcttatgctttccatgggattcaagacagaagtcatcattgctattctcatttgcattatggtaatatttgggtttatttttttgactttgggtttaaaacaacggagaaaacagattctatttcctgagaaaagtgaagatttcagagagaatatattccgatatgatgacgaagggggtggagaagaagatacagaggcctttgacgtagcagcgctgaggagtagcaccataatgcgggaacgcaagactcggaaaaccaccagcgctgagatcaggagcctatacaggcagtctttgcaagttggccccgacagtgccatattcaggaagttcatcctggaaaagctcgaagaagctgatactgatccgtgtgcccctccttttgattccctccagacctacgcttttgagggaacagggtcattagctggatccctgagctccttagaatcagctgtctctgatcaggatgaaagctatgattaccttaacgagttgggacctcgctttaaaagattagcatgcatgtttggttctgcagtgcagtcaaataattag

SEQ ID NO: 948 - protein, 596 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTE

SEQ ID NO: 949 - DNA, 1788 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaa

SEQ ID NO: 950 - protein, 624 aa, human
MNCYLLLRFMLGIPLLWPCLGATENSQTKKVKQPVRSHLRVKRGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQ

SEQ ID NO: 951 - DNA, 1872 bp, human
atgaactgttatttactgctgcgttttatgttgggaattcctctcctatggccttgtcttggagcaacagaaaactctcaaacaaagaaagtcaagcagccagtgcgatctcatttgagagtgaagcgtggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgagcctcctcttttcctccttccatattatgtatttgaagtttttgaagaaaccccacagggatcatttgtaggcgtggtgtctgccacagacccagacaataggaaatctcctatcaggtattctattactaggagcaaagtgttcaatatcaatgataatggtacaatcactacaagtaactcactggatcgtgaaatcagtgcttggtacaacctaagtattacagccacagaaaaatacaatatagaacagatctcttcgatcccactgtatgtgcaagttcttaacatcaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacag

SEQ ID NO: 952 - protein, 729 aa, artificial
  huCDH19 (44-141) muCDH19 (140-770)
GWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 953 - DNA, 2190 bp, artificial
  huCDH19 (44-141) muCDH19 (140-770)
ggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 954 - protein, 729 aa, artificial
  huCDH19 (44-249) muCDH19 (248-770)
GWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 955 - DNA, 2190 bp, artificial
  huCDH19 (44-249) muCDH19 (248-770)
ggctgggtgtggaaccaattttttgtaccagaggaaatgaatacgactagtcatcacatcggccagctaagatctgatttagacaatggaaacaattctttccagtacaagcttttgggagctggagctggaagtacttttatcattgatgaaagaacaggtgacatatatgccatacagaagcttgatagagaggagcgatccctctacatcttaagagcccaggtaatagacatcgctactggaagggctgtggaacctgagtctgagtttgtcatcaaagtttcggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 956 - protein, 727 aa, artificial
  muCDH19 (44-139) huCDH19 (142-249) muCDH19 (248-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 957 - DNA, 2184 bp, artificial
  muCDH19 (44-139) huCDH19 (142-249) muCDH19 (248-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 958 - protein, 727 aa, artificial
  muCDH19 (44-139) huCDH19 (142-364) muCDH19 (363-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 959 - DNA, 2184 bp, artificial
  C137847 muCDH19 (44-139) huCDH19 (142-364) muCDH19 (363-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaaccaaaattcctagatgaaccttatgaggccattgtaccagagatgtctccagaaggaacattagttatccaggtgacagcaagtgatgctgacgatccctcaagtggtaataatgctcgtctcctctacagcttacttcaaggccagccatatttttctgttgaaccaacaacaggagtcataagaatatcttctaaaatggatagagaactgcaagatgagtattgggtaatcattcaagccaaggacatgattggtcagccaggagcgttgtctggaacaacaagtgtattaattaaactttcagatgttaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 960 - protein, 727 aa, artificial
  C137911 muCDH19 (44-247) huCDH19 (250-364) muCDH19 (363-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 961 - DNA, 2184 bp, artificial
  C137911 muCDH19 (44-247) huCDH19 (250-364) muCDH19 (363-770)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaataagcctatatttaaagaaagtttataccgcttgactgtctctgaatctgcacccactgggacttctataggaacaatcatggcatatgataatgacataggagagaatgcagaaatggattacagcattgaagaggatgattcgcaaacatttgacattattactaatcatgaaactcaagaaggaatagttatattaaaaaagaaagtggattttgagcaccagaaccactacggtattagagcaaaagttaaaaaccatcatgttcctgagcagctcatgaagtaccacactgaggcttccaccactttcattaagatccaggtggaagatgttgatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaacgacaatgctccagagttctctcaattctatgagacttatgtttgtgaaaatgctgaatctggtgagatagttcagatcatcagtgcaattgatagagatgagtccatagaagatcaccatttttactttaatcactctctggaagacacaaacaactcaagttttatgctaacagacaatcaagataacacagctgtaattctgagtaatagaactggtttcaatcttaaagaagagcctgtcttctacatgatcatcttgattgctgataacgggatcccatctctcacaagcacaaacactctcactatccaagtctgtgactgtggagacagtagaaacacagaaacttgtgctaacaagggacttctctttatcatgggattcagaacagaggcaataattgccatcatgatatgtgttatggtaatatttgggtttttctttttgattcttgctctgaaacagcgaagaaaggagactctatttccagagaagactgaagactttagggagaatatattttgctatgatgatgaaggcggcggggaagaagactcggaagcctttgacatcgtagagctgagacaaagtacagtaatgagagaaagaaagcctcagagaagcaagagtgcggagatcaggagcttgtacaggcagtccctgcaggtgggcccagacagtgccatatttcgaaaatttatcctagagaagcttgaagaagccaacacagacccatgtgctcccccctttgattcactacagacgtttgcctatgagggaacagggtcatcagctggctctctgagctccttggcatccagagacactgatcaggaggatgacttcgactaccttaatgacctgggacctcgttttaaaagattagcaagcatgtttggctctgcagtacaacccaacaattag

SEQ ID NO: 962 - protein, 727 aa, artificial
  C137917 muCDH19 (44-362) huCDH19 (365-772)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 963 - protein, 2184 aa, artificial
  C137917 muCDH19 (44-362) huCDH19 (365-772)
GCCTGGGTGTGGAGACCATTTGTTGTTCTAGAAGAAATGGATGATATACAATGTGTTGGAAAGCTAAGATCTGACTTAGACAATGGAAACAACTCTTTCCAGTACAAGCTACTGGGGATTGGCGCTGGAAGCTTTAGCATTAATGAAAGAACAGGTGAAATATGTGCCATACAGAAGCTTGATAGAGAGGAAAAATCCCTCTACATTCTGAGAGCCCAGGTAATAGACACCACTATTGGGAAGGCTGTGGAAACTGAATCCGAGTTTGTCATCAGAGTTTTGGATATCAATGACAATGAACCCAGATTCCTAGATGAACCATATGAGGCCATTGTACCTGAGATGTCTCCAGAAGGAACATTTGTCATCAAGGTGACAGCCAATGACGCAGATGATCCTTCAACTGGCTATCATGCTCGCATCCTATACAACTTAGAACGAGGTCAACCATACTTTTCTGTTGAGCCAACAACAGGAGTCATAAGGATATCTTCTAAGATGGATAGAGAGTTGCAAGATACATACTGTGTAATTATTCAAGCCAAGGACATGCTCGGTCAGCCTGGAGCCTTGTCTGGAACAACAACCGTATCAATTAAGCTGTCAGATATTAATGACAACAAGCCAATATTCAAAGAAAGTTTCTACCGCTTCACTATATCTGAATCTGCACCCATTGGAACATCAATAGGGAAAATTATGGCATATGATGATGACATAGGGGAGAATGCAGAGATGGAGTACAGCATTGAAGATGATGATTCAAAAATATTTGACATAATCATTGACAATGACACCCAAGAAGGGATAGTTATACTTAAAAAGAAAGTTGATTTTGAGCAGCAGAGCTATTATGGCATTAGAGCTAAGGTTAAAAACTGCCATGTGGATGAAGAGCTTGCACCTGCCCATGTTAACGCTTCCACAACCTACATTAAAGTTCAAGTAGAAGATGAAGATGAGCCTCCTCTTTTCCTCCTTCCATATTATGTATTTGAAGTTTTTGAAGAAACCCCACAGGGATCATTTGTAGGCGTGGTGTCTGCCACAGACCCAGACAATAGGAAATCTCCTATCAGGTATTCTATTACTAGGAGCAAAGTGTTCAATATCAATGATAATGGTACAATCACTACAAGTAACTCACTGGATCGTGAAATCAGTGCTTGGTACAACCTAAGTATTACAGCCACAGAAAAATACAATATAGAACAGATCTCTTCGATCCCACTGTATGTGCAAGTTCTTAACATCAATGATCATGCTCCTGAGTTCTCTCAATACTATGAGACTTATGTTTGTGAAAATGCAGGCTCTGGTCAGGTAATTCAGACTATCAGTGCAGTGGATAGAGATGAATCCATAGAAGAGCACCATTTTTACTTTAATCTATCTGTAGAAGACACTAACAATTCAAGTTTTACAATCATAGATAATCAAGATAACACAGCTGTCATTTTGACTAATAGAACTGGTTTTAACCTTCAAGAAGAACCTGTCTTCTACATCTCCATCTTAATTGCCGACAATGGAATCCCGTCACTTACAAGTACAAACACCCTTACCATCCATGTCTGTGACTGTGGTGACAGTGGGAGCACACAGACCTGCCAGTACCAGGAGCTTGTGCTTTCCATGGGATTCAAGACAGAAGTCATCATTGCTATTCTCATTTGCATTATGATCATATTTGGGTTTATTTTTTTGACTTTGGGTTTAAAACAACGGAGAAAACAGATTCTATTTCCTGAGAAAAGTGAAGATTTCAGAGAGAATATATTCCAATATGATGATGAAGGGGGTGGAGAAGAAGATACAGAGGCCTTTGATATAGCAGAGCTGAGGAGTAGTACCATAATGCGGGAACGCAAGACTCGGAAAACCACAAGCGCTGAGATCAGGAGCCTATACAGGCAGTCTTTGCAAGTTGGCCCCGACAGTGCCATATTCAGGAAATTCATTCTGGAAAAGCTCGAAGAAGCTAATACTGATCCGTGTGCCCCTCCTTTTGATTCCCTCCAGACCTACGCTTTTGAGGGAACAGGGTCATTAGCTGGATCCCTGAGCTCCTTAGAATCAGCAGTCTCTGATCAGGATGAAAGCTATGATTACCTTAATGAGTTGGGACCTCGCTTTAAAAGATTAGCATGCATGTTTGGTTCTGCAGTGCAGTCAAATAATTAG

SEQ ID NO: 964 - protein, 727 aa, artificial
  C137915 muCDH19 (44-461) huCDH19 (464-772)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 965 - DNA, 2184 bp, artificial
  C137915 muCDH19 (44-461) huCDH19 (464-772)
gcctgggtgtggagaccatttgttgttctagaagaaatggatgatatacaatgtgttggaaagctaagatctgacttagacaatggaaacaactctttccagtacaagctactggggattggcgctggaagctttagcattaatgaaagaacaggtgaaatatgtgccatacagaagcttgatagagaggaaaaatccctctacattctgagagcccaggtaatagacaccactattgggaaggctgtggaaactgaatccgagtttgtcatcagagttttggatatcaatgacaatgaacccagattcctagatgaaccatatgaggccattgtacctgagatgtctccagaaggaacatttgtcatcaaggtgacagccaatgacgcagatgatccttcaactggctatcatgctcgcatcctatacaacttagaacgaggtcaaccatacttttctgttgagccaacaacaggagtcataaggatatcttctaagatggatagagagttgcaagatacatactgtgtaattattcaagccaaggacatgctcggtcagcctggagccttgtctggaacaacaaccgtatcaattaagctgtcagatattaatgacaacaagccaatattcaaagaaagtttctaccgcttcactatatctgaatctgcacccattggaacatcaatagggaaaattatggcatatgatgatgacataggggagaatgcagagatggagtacagcattgaagatgatgattcaaaaatatttgacataatcattgacaatgacacccaagaagggatagttatacttaaaaagaaagttgattttgagcagcagagctattatggcattagagctaaggttaaaaactgccatgtggatgaagagcttgcacctgcccatgttaacgcttccacaacctacattaaagttcaagtagaagatgaagatgaacctcctgttttcctcttaccatattacatacttgaaattcctgaaggaaaaccatatggaacaattgtggggacggtttctgccacagacccagatcgaagacaatctcctatgagatattatctcactggaagcaaaatgtttgatatcaatgacaatggaacaataatcaccactaacatgcttgacagagaggtcagtgcttggtacaacttgactgtcacagctactgaaacatacaatgtacaacagatctcttcagcccatgtttatgtacaagtctttaacattaatgatcatgctcctgagttctctcaatactatgagacttatgtttgtgaaaatgcaggctctggtcaggtaattcagactatcagtgcagtggatagagatgaatccatagaagagcaccatttttactttaatctatctgtagaagacactaacaattcaagttttacaatcatagataatcaagataacacagctgtcattttgactaatagaactggttttaaccttcaagaagaacctgtcttctacatctccatcttaattgccgacaatggaatcccgtcacttacaagtacaaacacccttaccatccatgtctgtgactgtggtgacagtgggagcacacagacctgccagtaccaggagcttgtgctttccatgggattcaagacagaagtcatcattgctattctcatttgcattatgatcatatttgggtttatttttttgactttgggtttaaaacaacggagaaaacagattctatttcctgagaaaagtgaagatttcagagagaatatattccaatatgatgatgaagggggtggagaagaagatacagaggcctttgatatagcagagctgaggagtagtaccataatgcgggaacgcaagactcggaaaaccacaagcgctgagatcaggagcctatacaggcagtctttgcaagttggccccgacagtgccatattcaggaaattcattctggaaaagctcgaagaagctaatactgatccgtgtgcccctccttttgattccctccagacctacgcttttgagggaacagggtcattagctggatccctgagctccttagaatcagcagtctctgatcaggatgaaagctatgattaccttaatgagttgggacctcgctttaaaagattagcatgcatgtttggttctgcagtgcagtcaaataattag

SEQ ID NO: 966 - protein, 727 aa, artificial
  C71144 muCDH19 (44-770)
AWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 967 - protein, 2184 aa, artificial
  C71144 muCDH19 (44-770)
GCCTGGGTGTGGAGACCATTTGTTGTTCTAGAAGAAATGGATGATATACAATGTGTTGGAAAGCTAAGATCTGACTTAGACAATGGAAACAACTCTTTCCAGTACAAGCTACTGGGGATTGGCGCTGGAAGCTTTAGCATTAATGAAAGAACAGGTGAAATATGTGCCATACAGAAGCTTGATAGAGAGGAAAAATCCCTCTACATTCTGAGAGCCCAGGTAATAGACACCACTATTGGGAAGGCTGTGGAAACTGAATCCGAGTTTGTCATCAGAGTTTTGGATATCAATGACAATGAACCCAGATTCCTAGATGAACCATATGAGGCCATTGTACCTGAGATGTCTCCAGAAGGAACATTTGTCATCAAGGTGACAGCCAATGACGCAGATGATCCTTCAACTGGCTATCATGCTCGCATCCTATACAACTTAGAACGAGGTCAACCATACTTTTCTGTTGAGCCAACAACAGGAGTCATAAGGATATCTTCTAAGATGGATAGAGAGTTGCAAGATACATACTGTGTAATTATTCAAGCCAAGGACATGCTCGGTCAGCCTGGAGCCTTGTCTGGAACAACAACCGTATCAATTAAGCTGTCAGATATTAATGACAACAAGCCAATATTCAAAGAAAGTTTCTACCGCTTCACTATATCTGAATCTGCACCCATTGGAACATCAATAGGGAAAATTATGGCATATGATGATGACATAGGGGAGAATGCAGAGATGGAGTACAGCATTGAAGATGATGATTCAAAAATATTTGACATAATCATTGACAATGACACCCAAGAAGGGATAGTTATACTTAAAAAGAAAGTTGATTTTGAGCAGCAGAGCTATTATGGCATTAGAGCTAAGGTTAAAAACTGCCATGTGGATGAAGAGCTTGCACCTGCCCATGTTAACGCTTCCACAACCTACATTAAAGTTCAAGTAGAAGATGAAGATGAACCTCCTGTTTTCCTCTTACCATATTACATACTTGAAATTCCTGAAGGAAAACCATATGGAACAATTGTGGGGACGGTTTCTGCCACAGACCCAGATCGAAGACAATCTCCTATGAGATATTATCTCACTGGAAGCAAAATGTTTGATATCAATGACAATGGAACAATAATCACCACTAACATGCTTGACAGAGAGGTCAGTGCTTGGTACAACTTGACTGTCACAGCTACTGAAACATACAATGTACAACAGATCTCTTCAGCCCATGTTTATGTACAAGTCTTTAACATTAACGACAATGCTCCAGAGTTCTCTCAATTCTATGAGACTTATGTTTGTGAAAATGCTGAATCTGGTGAGATAGTTCAGATCATCAGTGCAATTGATAGAGATGAGTCCATAGAAGATCACCATTTTTACTTTAATCACTCTCTGGAAGACACAAACAACTCAAGTTTTATGCTAACAGACAATCAAGATAACACAGCTGTAATTCTGAGTAATAGAACTGGTTTCAATCTTAAAGAAGAGCCTGTCTTCTACATGATCATCTTGATTGCTGATAACGGGATCCCATCTCTCACAAGCACAAACACTCTCACTATCCAAGTCTGTGACTGTGGAGACAGTAGAAACACAGAAACTTGTGCTAACAAGGGACTTCTCTTTATCATGGGATTCAGAACAGAGGCAATAATTGCCATCATGATATGTGTTATGGTAATATTTGGGTTTTTCTTTTTGATTCTTGCTCTGAAACAGCGAAGAAAGGAGACTCTATTTCCAGAGAAGACTGAAGACTTTAGGGAGAATATATTTTGCTATGATGATGAAGGCGGCGGGGAAGAAGACTCGGAAGCCTTTGACATCGTAGAGCTGAGACAAAGTACAGTAATGAGAGAAAGAAAGCCTCAGAGAAGCAAGAGTGCGGAGATCAGGAGCTTGTACAGGCAGTCCCTGCAGGTGGGCCCAGACAGTGCCATATTTCGAAAATTTATCCTAGAGAAGCTTGAAGAAGCCAACACAGACCCATGTGCTCCCCCCTTTGATTCACTACAGACGTTTGCCTATGAGGGAACAGGGTCATCAGCTGGCTCTCTGAGCTCCTTGGCATCCAGAGACACTGATCAGGAGGATGACTTCGACTACCTTAATGACCTGGGACCTCGTTTTAAAAGATTAGCAAGCATGTTTGGCTCTGCAGTACAACCCAACAATTAG

SEQ ID NO: 968 - protein, 8 aa, artificial
  Flag Tag
DYKDDDDK

SEQ ID NO: 969 - DNA, 24 bp, artificial
  Flag Tag
gactacaaagacgatgacgacaag

SEQ ID NO: 970 - protein, 5 aa, artificial
  CDR-H1 of CDH19 2G6
SYGMH

SEQ ID NO: 971 - protein, 17 aa, artificial
  CDR-H2 of CDH19 2G6
FIWYDGSNKYYADSVKD

SEQ ID NO: 972 - protein, 16 aa, artificial
  CDR-H3 of CDH19 2G6
RAGIIGTIGYYYGMDV

SEQ ID NO: 973 - protein, 11 aa, artificial
  CDR-L1 of CDH19 2G6
SGDRLGEKYTC

SEQ ID NO: 974 - protein, 7 aa, artificial
  CDR-L2 of CDH19 2G6
QDTKRPS

SEQ ID NO: 975 - protein, 9 aa, artificial
  CDR-L3 of CDH19 2G6
QAWDSSTVV

SEQ ID NO: 976 - DNA, 375 bp, artificial
  VH of CDH19 2G6
caggtgcagctggtggaatccggcggaggcgtggtgcagcctggccggtccctgagactgtcttgcgccgcctccggcttcaccttctccagctacggcatgcactgggtccgacaggcccctggcaagggcctggaatgggtggccttcatttggtacgacggctccaacaagtactacgccgactccgtgaaggaccggttcaccatctcccgggacaactccaagaacaccctgtacctgcagatgaagtccctgcgggccgaggacaccgccgtgtactactgtgccagaagggccggcatcatcggcaccatcggctactactacggcatggacgtgtggggccagggcaccaccgtgaccgtgtctagc

SEQ ID NO: 977 - protein, 125 aa, artificial; identical to SEQ ID NO: 384
  VH of CDH19 2G6

SEQ ID NO: 978 - DNA, 315 bp, artificial
  VL of CDH19 2G6
tacgagctgacccagcccccctccgtgtccgtgtctcctggccagaccgcctccatcacctgttctggcgaccggctgggcgagaagtacacctgttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctg

SEQ ID NO: 979 - protein, 106 aa, artificial
  VL of CDH19 2G6
SYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVL

SEQ ID NO: 980 - DNA, 738 bp, artificial
  VH-VL of CDH19 2G6
caggtgcagctggtggaatccggcggaggcgtggtgcagcctggccggtccctgagactgtcttgcgccgcctccggcttcaccttctccagctacggcatgcactgggtccgacaggcccctggcaagggcctggaatgggtggccttcatttggtacgacggctccaacaagtactacgccgactccgtgaaggaccggttcaccatctcccgggacaactccaagaacaccctgtacctgcagatgaagtccctgcgggccgaggacaccgccgtgtactactgtgccagaagggccggcatcatcggcaccatcggctactactacggcatggacgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaagtacacctgttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctg

SEQ ID NO: 981 - protein, 246 aa, artificial
  VH-VL of CDH19 2G6
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVL

SEQ ID NO: 982 - protein, 507 aa, artificial
  CDH19 2G6 x I2C
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTCWYQQRPGQSPLLVIYQDTKRPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 983 - protein, 5 aa, artificial
  CDR-H1 of CDH19 16E2.1
SYGMH

SEQ ID NO: 984 - protein, 17 aa, artificial
  CDR-H2 of CDH19 16E2.1
VIWYDGSNKYYADSVKG

SEQ ID NO: 985 - protein, 9 aa, artificial
  CDR-H3 of CDH19 16E2.1
DGWELSFDY

SEQ ID NO: 986 - protein, 11 aa, artificial
  CDR-L1 of CDH19 16E2.1
RASQGISNYLA

SEQ ID NO: 987 - protein, 7 aa, artificial
  CDR-L2 of CDH19 16E2.1
AASSLQS

SEQ ID NO: 988 - protein, 9 aa, artificial
  CDR-L3 of CDH19 16E2.1
QHYFTYPRT

SEQ ID NO: 989 - DNA, 354 bp, artificial
  VH of CDH19 16E2.1
caggtgcagctggtggaatccggcggaggcgtggtgcagcctggccggtccctgagactgtcttgcgccgcctccggcttcatcttctccagctacggcatgcactgggtccgacagacccccggcaagggcctggaatgggtggccgtgatttggtacgacggctccaacaagtactacgccgactccgtgaagggccggttcaccatctcccgggacatctccaagaacaccctgtacctgcagatgaactccctgcgggtggaagataccgccgtgtactactgcgccagggacggctgggagctgtccttcgattactggggccagggcaccctggtcaccgtgtctagc

SEQ ID NO: 990 - protein, 118 aa, artificial; identical to SEQ ID NO: 350
  VH of CDH19 16E2.1

SEQ ID NO: 991 - DNA, 321 bp, artificial
  VL of CDH19 16E2.1
gacatccagatgacccagtccccctccagcctgtccgcctccgtgggcgacagagtgaccatcacctgtcgggcctcccagggcatcagcaactacctggcctggctgcagcagaagcccggcaaggcccccaagtccctgatctacgccgccagctccctgcagtccggcgtgccctccaagttctccggctctggctccggcaccgacttcaccctgaccatctccagcctgcagcccgaggacttcgccacctactactgccagcactacttcacctacccccggaccttcggacagggcaccaaggtggaaatcaag

SEQ ID NO: 992 - protein, 107 aa, artificial
  VL of CDH19 16E2.1
DIQMTQSPSSLSASVGDRVTITCRASQGISNYLAWLQQKPGKAPKSLIYAASSLQSGVPSKFSGSGSGTDFTLTISSLQPEDFATYYCQHYFTYPRTFGQGTKVEIK

SEQ ID NO: 993 - DNA, 720 bp, artificial
  VH-VL of CDH19 16E2.1
caggtgcagctggtggaatccggcggaggcgtggtgcagcctggccggtccctgagactgtcttgcgccgcctccggcttcatcttctccagctacggcatgcactgggtccgacagacccccggcaagggcctggaatgggtggccgtgatttggtacgacggctccaacaagtactacgccgactccgtgaagggccggttcaccatctcccgggacatctccaagaacaccctgtacctgcagatgaactccctgcgggtggaagataccgccgtgtactactgcgccagggacggctgggagctgtccttcgattactggggccagggcaccctggtcaccgtgtctagcggaggcggaggatctggtggcggtggttctggcggcggaggctccgacatccagatgacccagtccccctccagcctgtccgcctccgtgggcgacagagtgaccatcacctgtcgggcctcccagggcatcagcaactacctggcctggctgcagcagaagcccggcaaggcccccaagtccctgatctacgccgccagctccctgcagtccggcgtgccctccaagttctccggctctggctccggcaccgacttcaccctgaccatctccagcctgcagcccgaggacttcgccacctactactgccagcactacttcacctacccccggaccttcggacagggcaccaaggtggaaatcaag

SEQ ID NO: 994 - protein, 240 aa, artificial
  VH-VL of CDH19 16E2.1
QVQLVESGGGVVQPGRSLRLSCAASGFIFSSYGMHWVRQTPGKGLEWVAVIWYDGSNKYYADSVKGRFTISRDISKNTLYLQMNSLRVEDTAVYYCARDGWELSFDYWGQGTLVTVSSGGGGSGGGGSGGGGSDIQMTQSPSSLSASVGDRVTITCRASQGISNYLAWLQQKPGKAPKSLIYAASSLQSGVPSKFSGSGSGTDFTLTISSLQPEDFATYYCQHYFTYPRTFGQGTKVEIK

SEQ ID NO: 995 - protein, 501 aa, artificial
  CDH19 16E2.1 x I2C
QVQLVESGGGVVQPGRSLRLSCAASGFIFSSYGMHWVRQTPGKGLEWVAVIWYDGSNKYYADSVKGRFTISRDISKNTLYLQMNSLRVEDTAVYYCARDGWELSFDYWGQGTLVTVSSGGGGSGGGGSGGGGSDIQMTQSPSSLSASVGDRVTITCRASQGISNYLAWLQQKPGKAPKSLIYAASSLQSGVPSKFSGSGSGTDFTLTISSLQPEDFATYYCQHYFTYPRTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 996 - protein, 5 aa, artificial
  CDR-H1 of CDH19 17H8.2
SYYWS

SEQ ID NO: 997 - protein, 16 aa, artificial
  CDR-H2 of CDH19 17H8.2
YIYYIGSTNYNPSLKS

SEQ ID NO: 998 - protein, 14 aa, artificial
  CDR-H3 of CDH19 17H8.2
DSRYRSGWYDAFDI

SEQ ID NO: 999 - protein, 12 aa, artificial
  CDR-L1 of CDH19 17H8.2
RASQSVAGSYLA

SEQ ID NO: 1000 - protein, 7 aa, artificial
  CDR-L2 of CDH19 17H8.2
GASSRAT

SEQ ID NO: 1001 - protein, 9 aa, artificial
  CDR-L3 of CDH19 17H8.2
QQYGKSPIT

SEQ ID NO: 1002 - DNA, 366 bp, artificial
  VH of CDH19 17H8.2
caggtgcagctgcaggaatccggccctggcctggtcaagccctccgagacactgtccctgacctgcaccgtgtccggcggctccatcaactcctactactggtcctggatccggcagccccctggcaagggcctggaatggatcggctacatctactacatcggctccaccaactacaaccccagcctgaagtccagagtgaccatctccgtggacacctccaagaaccagttctccctgaagctgtcctccgtgaccgccgctgacaccgccctgtactactgcgccagagactcccggtacagatccgggtggtacgacgccttcgacatctggggccagggcaccatggtcaccgtgtcctct

SEQ ID NO: 1003 - protein, 122 aa, artificial; identical to SEQ ID NO: 338
  VH of CDH19 17H8.2

SEQ ID NO: 1004 - protein, 324 aa, artificial
  VL of CDH19 17H8.2
GATATCGTGCTGACCCAGTCCCCCGGCACCCTGTCTCTGAGCCCTGGCGAGAGAGCCACCCTGTCCTGCAGAGCCTCTCAGTCCGTGGCCGGCTCCTACCTGGCTTGGTATCAGCAGAAGCCCGGCCAGGCCCCTCGGCTGCTGATCTCCGGCGCCTCTTCTAGAGCCACCGGCATCCCTGACCGGTTCTCCGGCTCTGGCTCCGGCACCGACTTCACCCTGACCATCAGCCGGCTGGAACCCGAGGACTTCGCCGTGTACTATTGCCAGCAGTACGGCAAGTCCCCCATCACCTTCGGCCAGGGAACCCGGCTGGAAATGAAG

SEQ ID NO: 1005 - protein, 108 aa, artificial
  VL of CDH19 17H8.2
DIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMK

SEQ ID NO: 1006 - DNA, 735 bp, artificial
  VH-VL of CDH19 17H8.2
caggtgcagctgcaggaatccggccctggcctggtcaagccctccgagacactgtccctgacctgcaccgtgtccggcggctccatcaactcctactactggtcctggatccggcagccccctggcaagggcctggaatggatcggctacatctactacatcggctccaccaactacaaccccagcctgaagtccagagtgaccatctccgtggacacctccaagaaccagttctccctgaagctgtcctccgtgaccgccgctgacaccgccctgtactactgcgccagagactcccggtacagatccgggtggtacgacgccttcgacatctggggccagggcaccatggtcaccgtgtcctctggtggcggaggctctggcggaggtggaagcggaggcggcggatccgatatcgtgctgacccagtcccccggcaccctgtctctgagccctggcgagagagccaccctgtcctgcagagcctctcagtccgtggccggctcctacctggcttggtatcagcagaagcccggccaggcccctcggctgctgatctccggcgcctcttctagagccaccggcatccctgaccggttctccggctctggctccggcaccgacttcaccctgaccatcagccggctggaacccgaggacttcgccgtgtactattgccagcagtacggcaagtcccccatcaccttcggccagggaacccggctggaaatgaag

SEQ ID NO: 1007 - protein, 245 aa, artificial
  VH-VL of CDH19 17H8.2
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSGGGGSGGGGSGGGGSDIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMK

SEQ ID NO: 1008 - protein, 506 aa, artificial
  CDH19 17H8.2 x I2C
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSGGGGSGGGGSGGGGSDIVLTQSPGTLSLSPGERATLSCRASQSVAGSYLAWYQQKPGQAPRLLISGASSRATGIPDRFSGSGSGTDFTLTISRLEPEDFAVYYCQQYGKSPITFGQGTRLEMKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1009 - protein, 5 aa, artificial
  CDR-H1 of CDH19 19B5.1
SYFIH

SEQ ID NO: 1010 - protein, 17 aa, artificial
  CDR-H2 of CDH19 19B5.1
IINPISVSTSYAQKFQG

SEQ ID NO: 1011 - protein, 11 aa, artificial
  CDR-H3 of CDH19 19B5.1
GGIQLWLHLDY

SEQ ID NO: 1012 - protein, 13 aa, artificial
  CDR-L1 of CDH19 19B5.1
SGSRSNIGSNFVN

SEQ ID NO: 1013 - protein, 7 aa, artificial
  CDR-L2 of CDH19 19B5.1
TNNQRPS

SEQ ID NO: 1014 - protein, 11 aa, artificial
  CDR-L3 of CDH19 19B5.1
ATWDDSMNGWV

SEQ ID NO: 1015 - DNA, 360 bp, artificial
  VH of CDH19 19B5.1
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctct

SEQ ID NO: 1016 - protein, 120 aa, artificial; identical to SEQ ID NO: 368
  VH of CDH19 19B5.1

SEQ ID NO: 1017 - DNA, 330 bp, artificial
  VL of CDH19 19B5.1
cagtctgccctgacccagcctccctccaccaccggcacacctggccagcgcgtgaccatctcctgctccggctcccggtccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccatgaacggctgggtgttcggcggaggcaccaagctgaccgtgctg

SEQ ID NO: 1018 - protein, 110 aa, artificial
  VL of CDH19 19B5.1
QSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVL

SEQ ID NO: 1019 - DNA, 735 bp, artificial
  VH-VL of CDH19 19B5.1
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctctggtggcggaggatctggcggaggtggaagcggaggcggcggatctcagtctgccctgacccagcctccctccaccaccggcacacctggccagcgcgtgaccatctcctgctccggctcccggtccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccatgaacggctgggtgttcggcggaggcaccaagctgaccgtgctg

SEQ ID NO: 1020 - protein, 245 aa, artificial
  VH-VL of CDH19 19B5.1
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVL

SEQ ID NO: 1021 - protein, 506 aa, artificial
  CDH19 19B5.1 x I2C
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSTTGTPGQRVTISCSGSRSNIGSNFVNWYKQLPGTAPKVLIYTNNQRPSGVPDRFSGSKSGTSASLAISGLQSEDESDYYCATWDDSMNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1022 - protein, 5 aa, artificial
  CDR-H1 of CDH19 20D3.1
SYFIH

SEQ ID NO: 1023 - protein, 17 aa, artificial
  CDR-H2 of CDH19 20D3.1
IINPISVSTSYAQKFQG

SEQ ID NO: 1024 - protein, 11 aa, artificial
  CDR-H3 of CDH19 20D3.1
GGIQLWLHFDY

SEQ ID NO: 1025 - protein, 13 aa, artificial
  CDR-L1 of CDH19 20D3.1
SGSSSNIGSNFVN

SEQ ID NO: 1026 - protein, 7 aa, artificial
  CDR-L2 of CDH19 20D3.1
TNNQRPS

SEQ ID NO: 1027 - protein, 11 aa, artificial
  CDR-L3 of CDH19 20D3.1
ATWDDSLNGWV

SEQ ID NO: 1028 - DNA, 360 bp, artificial
  VH of CDH19 20D3.1
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacttcgactactggggccagggcaccctggtcaccgtgtctagc

SEQ ID NO: 1029 - protein, 120 aa, artificial; identical to SEQ ID NO: 342
  VH of CDH19 20D3.1

SEQ ID NO: 1030 - DNA, 330 bp, artificial
  VL of CDH19  20D3.1
cagtctgccctgacccagcctccttctgccaccggcacccctggccagcgcgtgaccatctcctgctccggctcctcctccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccctgaacggctgggtgttcggcggaggcaccaagctgaccgtgctg

SEQ ID NO: 1031 - protein, 110 aa, artificial
  VL of CDH19  20D3.1
QSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVL

SEQ ID NO: 1032 - DNA, 735 bp, artificial
  VH-VL of CDH19 20D3.1
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctctcagtctgccctgacccagcctccttctgccaccggcacccctggccagcgcgtgaccatctcctgctccggctcctcctccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccctgaacggctgggtgttcggcggaggcaccaagctgaccgtgctg

SEQ ID NO: 1033 - protein, 245 aa, artificial
  VH-VL of CDH19 20D3.1
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVL

SEQ ID NO: 1034 - protein, 506 aa, artificial
  CDH19 20D3.1 x I2C
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHFDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1035 - protein, 5 aa, artificial
  CDR-H1 of CDH19 22D1.1
SYFIH

SEQ ID NO: 1036 - protein, 17 aa, artificial
  CDR-H2 of CDH19 22D1.1
IINPISVSTSYAQKFQG

SEQ ID NO: 1037 - protein, 11 aa, artificial
  CDR-H3 of CDH19 22D1.1
GGIQLWLHLDY

SEQ ID NO: 1038 - protein, 13 aa, artificial
  CDR-L1 of CDH19 22D1.1
SGSSSNIGSNFVN

SEQ ID NO: 1039 - protein, 7 aa, artificial
  CDR-L2 of CDH19 22D1.1
TNNQRPS

SEQ ID NO: 1040 - protein, 11 aa, artificial
  CDR-L3 of CDH19 22D1.1
ATWDDSMNGWV

SEQ ID NO: 1041 - DNA, 360 bp, artificial
  VH of CDH19 22D1.1
caggtgcagctggtgcagtctggcgccgaagtgaagaaacctggcgcctccgtgcgggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctct

SEQ ID NO: 1042 - protein, 120 aa, artificial; identical to SEQ ID NO: 366
  VH of CDH19 22D1.1

SEQ ID NO: 1043 - DNA, 330 bp, artificial
  VL of CDH19 22D1.1
cagtctgccctgacccagcctccttccgctaccggcacccctggccagcgcgtgaccatctcctgctccggctcctcctccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccatgaacggctgggtgttcggcggaggcaccaagctgaccgtgctg

SEQ ID NO: 1044 - protein, 110 aa, artificial
  VL of CDH19 22D1.1
QSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVL

SEQ ID NO: 1045 - DNA, 735 bp, artificial
  VH-VL of CDH19 22D1.1
caggtgcagctggtgcagtctggcgccgaagtgaagaaacctggcgcctccgtgcgggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctctggtggcggaggatctggcggaggtggaagcggaggcggcggatctcagtctgccctgacccagcctccttccgctaccggcacccctggccagcgcgtgaccatctcctgctccggctcctcctccaacatcggctccaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccacctgggacgactccatgaacggctgggtgttcggcggaggcaccaagctgaccgtgctg

SEQ ID NO: 1046 - protein, 245 aa, artificial
  VH-VL of CDH19 22D1.1
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVL

SEQ ID NO: 1047 - protein, 506 aa, artificial
  CDH19 22D1.1 x I2C
QVQLVQSGAEVKKPGASVRVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSATGTPGQRVTISCSGSSSNIGSNFVNWYKQLPGTAPKVLIYTNNQRPSGVPDRFSGSKSGTSASLAISGLQSEDESDYYCATWDDSMNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1048 - protein, 5 aa, artificial
  CDR-H1 of CDH19 22G10.1
SYAMN

SEQ ID NO: 1049 - protein, 17 aa, artificial
  CDR-H2 of CDH19 22G10.1
TISGGGANTYYADSVKG

SEQ ID NO: 1050 - protein, 12 aa, artificial
  CDR-H3 of CDH19 22G10.1
GGMGGYYYGMDV

SEQ ID NO: 1051 - protein, 11 aa, artificial
  CDR-L1 of CDH19 22G10.1
RASQSISSNLA

SEQ ID NO: 1052 - protein, 7 aa, artificial
  CDR-L2 of CDH19 22G10.1
GAFTRAT

SEQ ID NO: 1053 - protein, 9 aa, artificial
  CDR-L3 of CDH19 22G10.1
QQYNYWPLT

SEQ ID NO: 1054 - DNA, 363 bp, artificial
  VH of CDH19 22G10.1
gaggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcctccgacaactccaagtccaccctgtacctgcagatgaactccctgagagccgccgacaccgccgtgtaccactgtgctaagggcggcatgggcggctactactacggcatggatgtgtggggccagggcaccaccgtgaccgtgtctagc

SEQ ID NO: 1055 - protein, 121 aa, artificial; identical to SEQ ID NO: 378
  VH of CDH19 22G10.1

SEQ ID NO: 1056 - DNA, 321 bp, artificial
  VL of CDH19 22G10.1
gagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaag

SEQ ID NO: 1057 - protein, 107 aa, artificial
  VL of CDH19 22G10.1
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIK

SEQ ID NO: 1058 - DNA, 729 bp, artificial
  VH-VL of CDH19 22G10.1
gaggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcctccgacaactccaagtccaccctgtacctgcagatgaactccctgagagccgccgacaccgccgtgtaccactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaag

SEQ ID NO: 1059 - protein, 243 aa, artificial
  VH-VL of CDH19 22G10.1
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIK

SEQ ID NO: 1060 - protein, 504 aa, artificial
  CDH19 22G10.1 x I2C
EVQLLESGGGLVQPGGSLRLSCAASGFTFSSYAMNWVRQAPGKGLEWVSTISGGGANTYYADSVKGRFTISSDNSKSTLYLQMNSLRAADTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1061 - protein, 5 aa, artificial
  CDR-H1 of CDH19 23A10.3
RYGIH

SEQ ID NO: 1062 - protein, 17 aa, artificial
  CDR-H2 of CDH19 23A10.3
VIWYDGSNKYYADSVKG

SEQ ID NO: 1063 - protein, 16 aa, artificial
  CDR-H3 of CDH19 23A10.3
RAGIPGTTGYYYGMDV

SEQ ID NO: 1064 - protein, 11 aa, artificial
  CDR-L1 of CDH19 23A10.3
SGDRLGEKYVC

SEQ ID NO: 1065 - protein, 7 aa, artificial
  CDR-L2 of CDH19 23A10.3
QDNKWPS

SEQ ID NO: 1066 - protein, 9 aa, artificial
  CDR-L3 of CDH19 23A10.3
QAWDSSTVV

SEQ ID NO: 1067 - protein, 375 aa, artificial
  VH of CDH19 23A10.3
CAGGTGCAGCTGGTGGAATCCGGCGGAGGCGTGGTGCAGCCTGGCCGGTCCCTGAGACTGTCTTGCGCCGCCTCCGGCTTCACCTTCTCCAGATACGGCATCCACTGGGTCCGACAGGCCCCTGGCAAGGGCCTGGAATGGGTGGCCGTGATTTGGTACGACGGCTCCAACAAGTACTACGCCGACTCCGTGAAGGGCCGGTTCACCATCTCCCGGGACAACTCCAAGAACACCCTGTACCTGCTGATGAACTCCCTGCGGGCCGAGGACTCCGCCGTGTACTACTGTGCCAGAAGGGCCGGCATCCCCGGCACCACCGGCTACTACTACGGCATGGATGTGTGGGGCCAGGGCACCACCGTGACCGTGTCTAGC

SEQ ID NO: 1068 - protein, 125 aa, artificial; identical to SEQ ID NO: 390
  VH of CDH19 23A10.3

SEQ ID NO: 1069 - DNA, 315 bp, artificial
  VL of CDH19 23A10.3
tacgagctgacccagcccccctccgtgtccgtgtctcctggccagaccgcctccatcacctgttctggcgaccggctgggcgagaaatacgtgtgctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctg

SEQ ID NO: 1070 - protein, 106 aa, artificial
  VL of CDH19 23A10.3
SYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVL

SEQ ID NO: 1071 - DNA, 738 bp, artificial
  VH-VL of CDH19 23A10.3
caggtgcagctggtggaatccggcggaggcgtggtgcagcctggccggtccctgagactgtcttgcgccgcctccggcttcaccttctccagatacggcatccactgggtccgacaggcccctggcaagggcctggaatgggtggccgtgatttggtacgacggctccaacaagtactacgccgactccgtgaagggccggttcaccatctcccgggacaactccaagaacaccctgtacctgctgatgaactccctgcgggccgaggactccgccgtgtactactgtgccagaagggccggcatccccggcaccaccggctactactacggcatggatgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaaatacgtgtgctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctg

SEQ ID NO: 1072 - protein, 246 aa, artificial
  VH-VL of CDH19 23A10.3
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSGGGGSGGGGSGGGGSSYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVL

SEQ ID NO: 1073 - protein, 507 aa, artificial
  CDH19 23A10.3 x I2C
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSGGGGSGGGGSGGGGSSYELTQPPSVSVSPGQTASITCSGDRLGEKYVCWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1074 - protein, 5 aa, artificial
  CDR-H1 of CDH19 25F8.1
SYYIH

SEQ ID NO: 1075 - protein, 17 aa, artificial
  CDR-H2 of CDH19 25F8.1
IINPSGGSTRYAQKFQG

SEQ ID NO: 1076 - protein, 11 aa, artificial
  CDR-H3 of CDH19 25F8.1
GGIQLWLHFDY

SEQ ID NO: 1077 - protein, 13 aa, artificial
  CDR-L1 of CDH19 25F8.1
SGSSSNIGRNFVN

SEQ ID NO: 1078 - protein, 7 aa, artificial
  CDR-L2 of CDH19 25F8.1
TNNQRPS

SEQ ID NO: 1079 - protein, 11 aa, artificial
  CDR-L3 of CDH19 25F8.1
AAWDDSLNGWV

SEQ ID NO: 1080 - DNA, 360 bp, artificial
  VH of CDH19 25F8.1
caggtgcagctggtgcagtctggcgccgaagtgaagaaacctggcgcctccgtgaaggtgtcctgcaaggcctccggctacaccttcaccagctactacatccactgggtccgacaggccccaggccagggcctggaatggatgggcatcatcaacccctccggcggctccaccagatacgcccagaaattccagggcagagtgaccatgacccgggacacctccacctccaccgtgttcatggaactgtcctccctgcggagcgaggacaccgccgtgtactactgcgccagaggcggcatccagctgtggctgcacttcgactactggggccagggcaccctggtcaccgtgtctagc

SEQ ID NO: 1081 - protein, 120 aa, artificial; identical to SEQ ID NO: 370
  VH of CDH19 25F8.1

SEQ ID NO: 1082 - DNA, 330 bp, artificial
  VL of CDH19 25F8.1
cagtctgccctgacccagcctccttctgccaccggcacccctggccagcgcgtgaccatctcctgctccggctcctcctccaacatcggccggaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccgcctgggacgactccctgaacggctgggtgttcggcggaggcaccaagctgaccgtgctg

SEQ ID NO: 1083 - protein, 110 aa, artificial
  VL of CDH19 25F8.1
QSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVL

SEQ ID NO: 1084 - DNA, 735 bp, artificial
  VH-VL of CDH19 25F8.1
caggtgcagctggtgcagtctggcgccgaagtgaagaaacctggcgcctccgtgaaggtgtcctgcaaggcctccggctacaccttcaccagctactacatccactgggtccgacaggccccaggccagggcctggaatggatgggcatcatcaacccctccggcggctccaccagatacgcccagaaattccagggcagagtgaccatgacccgggacacctccacctccaccgtgttcatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctctcagtctgccctgacccagcctccttctgccaccggcacccctggccagcgcgtgaccatctcctgctccggctcctcctccaacatcggccggaacttcgtgaactggtacaagcagctgcccggcaccgcccccaaggtgctgatctacaccaacaaccagcggccctccggcgtgcccgaccggttctctggctccaagtctggcacctccgcctccctggccatctccggcctgcagtccgaggacgagtccgactactactgtgccgcctgggacgactccctgaacggctgggtgttcggcggaggcaccaagctgaccgtgctg

SEQ ID NO: 1085 - protein, 245 aa, artificial
  VH-VL of CDH19 25F8.1
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSSGGGGSGGGGSGGGGSQSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVL

SEQ ID NO: 1086 - protein, 506 aa, artificial
  CDH19 25F8.1 x I2C
QVQLVQSGAEVKKPGASVKVSCKASGYTFTSYYIHWVRQAPGQGLEWMGIINPSGGSTRYAQKFQGRVTMTRDTSTSTVFMELSSLRSEDTAVYYCARGGIQLWLHFDYWGQGTLVTVSSGGGGSGGGGSGGGGSQSALTQPPSATGTPGQRVTISCSGSSSNIGRNFVNWYKQLPGTAPKVLIYTNNQRPSGVPDRFSGSKSGTSASLAISGLQSEDESDYYCAAWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1087 - protein, 5 aa, artificial
  CDR-H1 of CDH19 25G10.1
GYYWS

SEQ ID NO: 1088 - protein, 16 aa, artificial
  CDR-H2 of CDH19 25G10.1
YIYYIGSTNYNPSLKS

SEQ ID NO: 1089 - protein, 12 aa, artificial
  CDR-H3 of CDH19 25G10.1
DGSSGWYRWFDP

SEQ ID NO: 1090 - protein, 12 aa, artificial
  CDR-L1 of CDH19 25G10.1
RASQSVSSSYLA

SEQ ID NO: 1091 - protein, 7 aa, artificial
  CDR-L2 of CDH19 25G10.1
GASSRAT

SEQ ID NO: 1092 - protein, 9 aa, artificial
  CDR-L3 of CDH19 25G10.1
QQYGNSPLT

SEQ ID NO: 1093 - DNA, 360 bp, artificial
  VH of CDH19 25G10.1
caggtgcagctgcaggaatccggccctggcctggtcaagccctccgagacactgtccctgacctgcaccgtgtccggcggctccatctccggctactactggtcctggatccggcagccccctggcaagggcctggaatggatcggctacatctactacatcggctccaccaactacaaccccagcctgaagtccagagtgaccatgtccgtggacacctccaagaaccagttctccctgaagctgtcctccgtgaccgccgctgacaccgccgtgtactactgcgccagagatggctcctccggctggtatcgttggttcgacccttggggccagggcaccctggtcaccgtgtctagc

SEQ ID NO: 1094 - protein, 120 aa, artificial; identical to SEQ ID NO: 461
  VH of CDH19 25G10.1

SEQ ID NO: 1095 - DNA, 324 bp, artificial
  VL of CDH19 25G10.1
gagatcgtgctgacccagtcccctggcaccctgtccctgagccctggcgagagagccaccctgtcctgcagagcctcccagtccgtgtcctcctcctacctggcttggtatcagcagaagcccggccaggcccctcggctgctgatcttcggcgcctcttccagagccaccggcatccctgaccggttctccggctctggctccggcaccgacttcaccctgaccatctcccggctggaacccgaggacttcgctgtgtaccactgccagcagtacggcaacagccccctgaccttcggcggaggcaccaaggtggaaatcaag

SEQ ID NO: 1096 - protein, 108 aa, artificial
  VL of CDH19 25G10.1
EIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIK

SEQ ID NO: 1097 - DNA, 729 bp, artificial
  VH-VL of CDH19 25G10.1
caggtgcagctgcaggaatccggccctggcctggtcaagccctccgagacactgtccctgacctgcaccgtgtccggcggctccatctccggctactactggtcctggatccggcagccccctggcaagggcctggaatggatcggctacatctactacatcggctccaccaactacaaccccagcctgaagtccagagtgaccatgtccgtggacacctccaagaaccagttctccctgaagctgtcctccgtgaccgccgctgacaccgccgtgtactactgcgccagagatggctcctccggctggtatcgttggttcgacccttggggccagggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcttggtatcagcagaagcccggccaggcccctcggctgctgatcttcggcgcctcttccagagccaccggcatccctgaccggttctccggctctggctccggcaccgacttcaccctgaccatctcccggctggaacccgaggacttcgctgtgtaccactgccagcagtacggcaacagccccctgaccttcggcggaggcaccaaggtggaaatcaag

SEQ ID NO: 1098 - protein, 243 aa, artificial
  VH-VL of CDH19 25G10.1
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSGGGGSGGGGSGGGGSEIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIK

SEQ ID NO: 1099 - protein, 504 aa, artificial
  CDH19 25G10.1 x I2C
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSGGGGSGGGGSGGGGSEIVLTQSPGTLSLSPGERATLSCRASQSVSSSYLAWYQQKPGQAPRLLIFGASSRATGIPDRFSGSGSGTDFTLTISRLEPEDFAVYHCQQYGNSPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1100 - protein, 5 aa, artificial
  CDR-H1 of CDH19 26D1.1
SYYMS

SEQ ID NO: 1101 - protein, 17 aa, artificial
  CDR-H2 of CDH19 26D1.1
IIHPSGGDTTYAQKFQG

SEQ ID NO: 1102 - protein, 11 aa, artificial
  CDR-H3 of CDH19 26D1.1
GGIKLWLHFDY

SEQ ID NO: 1103 - protein, 13 aa, artificial
  CDR-L1 of CDH19 26D1.1
SGSRSNIGSNFVN

SEQ ID NO: 1104 - protein, 7 aa, artificial
  CDR-L2 of CDH19 26D1.1
TNNQRPS

SEQ ID NO: 1105 - protein, 11 aa, artificial
  CDR-L3 of CDH19 26D1.1
AVWDDSLNGWV

SEQ ID NO: 1106 - DNA, 360 bp, artificial
  VH of CDH19 26D1.1
caggtgcagctggtgcagtctggcgccgaagtgaagaaacctggcgcctccgtgaaggtgtcctgcaaggcctcccggtacaccttcaccagctactacatgtcctgggtccgacaggccccaggccagggcctggaatggatgggcatcatccacccctctggcggcgacaccacctacgcccagaaattccagggcagagtgaccatgaccggcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagc

SEQ ID NO: 1107 - protein, 120 aa, artificial; identical to SEQ ID NO: 372
  VH of CDH19 26D1.1

SEQ ID NO: 1108 - DNA, 330 bp, artificial
  VL of CDH19 26D1.1
cattccgtgctgacccagtctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctg

SEQ ID NO: 1109 - protein, 110 aa, artificial
  VL of CDH19 26D1.1
HSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVL

SEQ ID NO: 1110 - DNA, 735 bp, artificial
  VH-VL of CDH19 26D1.1
caggtgcagctggtgcagtctggcgccgaagtgaagaaacctggcgcctccgtgaaggtgtcctgcaaggcctcccggtacaccttcaccagctactacatgtcctgggtccgacaggccccaggccagggcctggaatggatgggcatcatccacccctctggcggcgacaccacctacgcccagaaattccagggcagagtgaccatgaccggcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagcggaggcggaggatctggtggcggtggttctggcggcggaggctcccattccgtgctgacccagtctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctg

SEQ ID NO: 1111 - protein, 245 aa, artificial
  VH-VL of CDH19 26D1.1
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSHSVLTQSPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVL

SEQ ID NO: 1112 - protein, 7 aa, artificial
  CDH19 26D1.1 x I2C
  misc_feature (5)..(5): Xaa can be any naturally occurring amino acid
CDHDXIC

SEQ ID NO: 1113 - protein, 5 aa, artificial
  CDR-H1 of CDH19 26F12.1
NYYMS

SEQ ID NO: 1114 - protein, 17 aa, artificial
  CDR-H2 of CDH19 26F12.1
IINPSGGDSTYAQKFQG

SEQ ID NO: 1115 - protein, 11 aa, artificial
  CDR-H3 of CDH19 26F12.1
GGIQLWLHFDY

SEQ ID NO: 1116 - protein, 13 aa, artificial
  CDR-L1 of CDH19 26F12.1
SGSRSNIGSNFVN

SEQ ID NO: 1117 - protein, 7 aa, artificial
  CDR-L2 of CDH19 26F12.1
TNYQRPS

SEQ ID NO: 1118 - protein, 11 aa, artificial
  CDR-L3 of CDH19 26F12.1
AVWDDSLNGWV

SEQ ID NO: 1119 - DNA, 360 bp, artificial
  VH of CDH19 26F12.1
caggtgcagctggtgcagtctggcgccgaagtgaagaaacctggcgcctccgtgaaggtgtcctgcaaggcctcccggtacaccttcaccaactactacatgtcctgggtccgacaggccccaggccagggcctggaatggatgggcatcatcaacccctctggcggcgactccacctacgcccagaagttccagggccggctgaccatgaccggcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagc

SEQ ID NO: 1120 - protein, 120 aa, artificial; identical to SEQ ID NO: 344
  VH of CDH19 26F12.1

SEQ ID NO: 1121 - DNA, 330 bp, artificial
  VL of CDH19 26F12.1
cagtctgtgctgacccagtccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctg

SEQ ID NO: 1122 - protein, 110 aa, artificial
  VL of CDH19 26F12.1
QSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVL

SEQ ID NO: 1123 - DNA, 735 bp, artificial
  VH-VL of CDH19 26F12.1
caggtgcagctggtgcagtctggcgccgaagtgaagaaacctggcgcctccgtgaaggtgtcctgcaaggcctcccggtacaccttcaccaactactacatgtcctgggtccgacaggccccaggccagggcctggaatggatgggcatcatcaacccctctggcggcgactccacctacgcccagaagttccagggccggctgaccatgaccggcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagtccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctg

SEQ ID NO: 1124 - protein, 245 aa, artificial
  VH-VL of CDH19 26F12.1
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVL

SEQ ID NO: 1125 - protein, 506 aa, artificial
  CDH19 26F12.1 x I2C
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQSPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1126 - protein, 5 aa, artificial
  CDR-H1 of CDH19 4A9
GYYWS

SEQ ID NO: 1127 - protein, 16 aa, artificial
  CDR-H2 of CDH19 4A9
YFSYSGSTNYNPSLKS

SEQ ID NO: 1128 - protein, 8 aa, artificial
  CDR-H3 of CDH19 4A9
NWAFHFDF

SEQ ID NO: 1129 - protein, 14 aa, artificial
  CDR-L1 of CDH19 4A9
TGSSSNIGTGYAVH

SEQ ID NO: 1130 - protein, 7 aa, artificial
  CDR-L2 of CDH19 4A9
GNNNRPS

SEQ ID NO: 1131 - protein, 11 aa, artificial
  CDR-L3 of CDH19 4A9
QSYDSRLSGWV

SEQ ID NO: 1132 - DNA, 348 bp, artificial
  VH of CDH19 4A9
caggtgcagctgcaggaatccggccctggcctggtcaagccctccgagacactgtccctgacctgcaccgtgtccggcggctccatctccggctactactggtcctggatccggcagccccctggcaagggcctggaatggttcgcctacttctcctactccggctccaccaactacaaccccagcctgaagtccagagtgaccctgtccgtggacacctccaagaaccagttctccctgaagctgtcctccgtgaccgccgctgacaccgccgtgtactactgcgcccggaactgggccttccacttcgatttctggggccagggcaccctggtcaccgtgtctagc

SEQ ID NO: 1133 - protein, 116 aa, artificial; identical to SEQ ID NO: 362
  VH of CDH19 4A9

SEQ ID NO: 1134 - DNA, 333 bp, artificial
  VL of CDH19 4A9
cagtctgtgctgacccagcctccctctgtgtctggcgcccctggccagagagtgaccatctcctgcaccggctcctccagcaacatcggcaccggctacgccgtgcactggtatcagcagttccccggcaccgcccccaagctgctgatctacggcaacaacaaccggccctccggcgtgcccgaccggttctctggctccaagtctggcacctccgcctccctggctatcaccggcctgcaggctgaggacgaggccgactactactgccagtcctacgactcccggctgtccggctgggtgttcggcggaggcaccaagctgaccgtgctg

SEQ ID NO: 1135 - protein, 111 aa, artificial
  VL of CDH19 4A9
QSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVL

SEQ ID NO: 1136 - DNA, 726 bp, artificial
  VH-VL of CDH19 4A9
caggtgcagctgcaggaatccggccctggcctggtcaagccctccgagacactgtccctgacctgcaccgtgtccggcggctccatctccggctactactggtcctggatccggcagccccctggcaagggcctggaatggttcgcctacttctcctactccggctccaccaactacaaccccagcctgaagtccagagtgaccctgtccgtggacacctccaagaaccagttctccctgaagctgtcctccgtgaccgccgctgacaccgccgtgtactactgcgcccggaactgggccttccacttcgatttctggggccagggcaccctggtcaccgtgtctagcggaggcggaggatctggtggcggtggttctggcggcggaggctcccagtctgtgctgacccagcctccctctgtgtctggcgcccctggccagagagtgaccatctcctgcaccggctcctccagcaacatcggcaccggctacgccgtgcactggtatcagcagttccccggcaccgcccccaagctgctgatctacggcaacaacaaccggccctccggcgtgcccgaccggttctctggctccaagtctggcacctccgcctccctggctatcaccggcctgcaggctgaggacgaggccgactactactgccagtcctacgactcccggctgtccggctgggtgttcggcggaggcaccaagctgaccgtgctg

SEQ ID NO: 1137 - protein, 242 aa, artificial
  VH-VL of CDH19 4A9
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVL

SEQ ID NO: 1138 - protein, 503 aa, artificial
  CDH19 4A9  x I2C
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQFPGTAPKLLIYGNNNRPSGVPDRFSGSKSGTSASLAITGLQAEDEADYYCQSYDSRLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1139 - protein, 5 aa, artificial
  CDR-H1 of CDH19 4B10
SYDMH

SEQ ID NO: 1140 - protein, 17 aa, artificial
  CDR-H2 of CDH19 4B10
VISYDGTNEYYADSVKG

SEQ ID NO: 1141 - protein, 10 aa, artificial
  CDR-H3 of CDH19 4B10
ERYFDWSFDY

SEQ ID NO: 1142 - protein, 12 aa, artificial
  CDR-L1 of CDH19 4B10
RASQSVSNTYLA

SEQ ID NO: 1143 - protein, 7 aa, artificial
  CDR-L2 of CDH19 4B10
GASSRAT

SEQ ID NO: 1144 - protein, 8 aa, artificial
  CDR-L3 of CDH19 4B10
QQYSNSWT

SEQ ID NO: 1145 - DNA, 357 bp, artificial
  VH of CDH19 4B10
caggtgcagctggtggaatccggcggaggcgtggtgcagcctggccggtccctgagactgtcttgcgccgcctccggcttcaccttctccagctacgacatgcactgggtccgacaggcccctggcaagggcctggaatgggtggccgtgatctcctacgacggcaccaacgagtactacgccgactccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagc

SEQ ID NO: 1146 - protein, 119 aa, artificial; identical to SEQ ID NO: 346
  VH of CDH19 4B10

SEQ ID NO: 1147 - DNA, 321 bp, artificial
  VL of CDH19 4B10
gagatcgtgctgacccagtcccctggcaccctgtccctgagccctggcgagagagccaccctgtcttgccgggcctcccagtccgtgtccaacacctacctggcctggtatcaccagcgccctggccaggcccctcggctgctgatctacggcgcctcttccagagccaccggcatccctgaccggttctccggctctggctctggcaccgacttcgccctgaccatctccagcctggaacccgaggatttcgctgtgtactattgccagcagtactccaactcctggaccttcggacagggcaccaaggtggaaatcaag

SEQ ID NO: 1148 - protein, 107 aa, artificial
  VL of CDH19 4B10
EIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIK

SEQ ID NO: 1149 - DNA, 723 bp, artificial
  VH-VL of CDH19 4B10
caggtgcagctggtggaatccggcggaggcgtggtgcagcctggccggtccctgagactgtcttgcgccgcctccggcttcaccttctccagctacgacatgcactgggtccgacaggcccctggcaagggcctggaatgggtggccgtgatctcctacgacggcaccaacgagtactacgccgactccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagcggaggcggaggatctggtggcggtggttctggcggcggaggctccgagatcgtgctgacccagtcccctggcaccctgtccctgagccctggcgagagagccaccctgtcttgccgggcctcccagtccgtgtccaacacctacctggcctggtatcaccagcgccctggccaggcccctcggctgctgatctacggcgcctcttccagagccaccggcatccctgaccggttctccggctctggctctggcaccgacttcgccctgaccatctccagcctggaacccgaggatttcgctgtgtactattgccagcagtactccaactcctggaccttcggacagggcaccaaggtggaaatcaag

SEQ ID NO: 1150 - protein, 241 aa, artificial
  VH-VL of CDH19 4B10
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIK

SEQ ID NO: 1151 - protein, 502 aa, artificial
  CDH19 4B10 x I2C
QVQLVESGGGVVQPGRSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYHQRPGQAPRLLIYGASSRATGIPDRFSGSGSGTDFALTISSLEPEDFAVYYCQQYSNSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1152 - protein, 5 aa, artificial
  CDR-H1 of CDH19 4F3
SYDMD

SEQ ID NO: 1153 - protein, 17 aa, artificial
  CDR-H2 of CDH19 4F3
VIWYDGSNKYYADSVRG

SEQ ID NO: 1154 - protein, 10 aa, artificial
  CDR-H3 of CDH19 4F3
ETGEGWYFDL

SEQ ID NO: 1155 - protein, 12 aa, artificial
  CDR-L1 of CDH19 4F3
RASQSVSSSYLA

SEQ ID NO: 1156 - protein, 7 aa, artificial
  CDR-L2 of CDH19 4F3
GASSRAT

SEQ ID NO: 1157 - protein, 8 aa, artificial
  CDR-L3 of CDH19 4F3
QQYGSSWT

SEQ ID NO: 1158 - DNA, 357 bp, artificial
  VH of CDH19 4F3
caggtgcagctggtggaatccggcggaggcgtggtgcagcctggccggtccctgagactgtcttgtgccgcctccggcttcagcttctcctcctacgacatggactgggtccgacagacccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagc

SEQ ID NO: 1159 - protein, 119 aa, artificial; identical to SEQ ID NO: 348
  VH of CDH19 4F3

SEQ ID NO: 1160 - DNA, 321 bp, artificial
  VL of CDH19 4F3
gagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagccggctggaacccgaggacttcgctgtgtactattgccagcagtacggctcctcctggaccttcggccagggcaccaaggtggaaatcaag

SEQ ID NO: 1161 - protein, 107 aa, artificial
  VL of CDH19 4F3
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIK

SEQ ID NO: 1162 - DNA, 723 bp, artificial
  VH-VL of CDH19 4F3
caggtgcagctggtggaatccggcggaggcgtggtgcagcctggccggtccctgagactgtcttgtgccgcctccggcttcagcttctcctcctacgacatggactgggtccgacagacccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagccggctggaacccgaggacttcgctgtgtactattgccagcagtacggctcctcctggaccttcggccagggcaccaaggtggaaatcaag

SEQ ID NO: 1163 - protein, 241 aa, artificial
  VH-VL of CDH19 4F3
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIK

SEQ ID NO: 1164 - protein, 502 aa, artificial
  CDH19 4F3 x I2C
QVQLVESGGGVVQPGRSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISRLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1165 - protein, 5 aa, artificial
  CDR-H1 of CDH19 4F7
SYSWS

SEQ ID NO: 1166 - protein, 16 aa, artificial
  CDR-H2 of CDH19 4F7
YIYYSGSTNYNPSLKS

SEQ ID NO: 1167 - protein, 8 aa, artificial
  CDR-H3 of CDH19 4F7
NWAFHFDY

SEQ ID NO: 1168 - protein, 14 aa, artificial
  CDR-L1 of CDH19 4F7
TGSSSNIGTGYDVH

SEQ ID NO: 1169 - protein, 7 aa, artificial
  CDR-L2 of CDH19 4F7
GNSNRPS

SEQ ID NO: 1170 - protein, 11 aa, artificial
  CDR-L3 of CDH19 4F7
QSYDSSLSGWV

SEQ ID NO: 1171 - DNA, 348 bp, artificial
  VH of CDH19 4F7
caggtgcagctgcaggaatccggccctggcctggtcaagccctccgagacactgtccctgacctgcaccgtgtccggcggctccatctcctcctactcttggtcctggatccggcagccccctggcaagggcctggaatggatcggctacatctactactccggctccaccaactacaaccccagcctgaagtccagagtgaccatctccctggacacctccaagaaccagttctccctgaagctgtcctccgtgaccgccgctgacaccgccgtgtactactgcgcccggaactgggccttccacttcgactactggggccagggcaccctggtcaccgtgtctagc

SEQ ID NO: 1172 - protein, 116 aa, artificial; identical to SEQ ID NO: 364
  VH of CDH19 4F7

SEQ ID NO: 1173 - DNA, 333 bp, artificial
  VL of CDH19 4F7
cagtctgtgctgacccagcctccctctgtgtctggcgcccctggccagcgcgtgaccatttcctgcaccggctcctccagcaacatcggcaccggctacgacgtgcactggtatcagcagctgcccggcaccgcccccaagctgctgatccacggcaactccaaccggccctccggcgtgcccgaccggttctctggctccaagtctggcacctccgcctccctggctatcaccggcctgcaggctgaggacgaggccgactactactgccagtcctacgactcctccctgtccggctgggtgttcggcggaggcaccagactgaccgtgctg

SEQ ID NO: 1174 - protein, 111 aa, artificial
  VL of CDH19 4F7
QSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVL

SEQ ID NO: 1175 - DNA, 726 bp, artificial
  VH-VL of CDH19 4F7
caggtgcagctgcaggaatccggccctggcctggtcaagccctccgagacactgtccctgacctgcaccgtgtccggcggctccatctcctcctactcttggtcctggatccggcagccccctggcaagggcctggaatggatcggctacatctactactccggctccaccaactacaaccccagcctgaagtccagagtgaccatctccctggacacctccaagaaccagttctccctgaagctgtcctccgtgaccgccgctgacaccgccgtgtactactgcgcccggaactgggccttccacttcgactactggggccagggcaccctggtcaccgtgtctagcggaggcggaggatctggtggcggtggttctggcggcggaggctcccagtctgtgctgacccagcctccctctgtgtctggcgcccctggccagcgcgtgaccatttcctgcaccggctcctccagcaacatcggcaccggctacgacgtgcactggtatcagcagctgcccggcaccgcccccaagctgctgatccacggcaactccaaccggccctccggcgtgcccgaccggttctctggctccaagtctggcacctccgcctccctggctatcaccggcctgcaggctgaggacgaggccgactactactgccagtcctacgactcctccctgtccggctgggtgttcggcggaggcaccagactgaccgtgctg

SEQ ID NO: 1176 - protein, 242 aa, artificial
  VH-VL of CDH19 4F7
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVL

SEQ ID NO: 1177 - protein, 503 aa, artificial
  CDH19 4F7 x I2C
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIHGNSNRPSGVPDRFSGSKSGTSASLAITGLQAEDEADYYCQSYDSSLSGWVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1178 - protein, 5 aa, artificial
  CDR-H1 of CDH19 14039
SYGMH

SEQ ID NO: 1179 - protein, 17 aa, artificial
  CDR-H2 of CDH19 14039
FIWYEGSNKYYAESVKD

SEQ ID NO: 1180 - protein, 16 aa, artificial
  CDR-H3 of CDH19 14039
RAGIIGTIGYYYGMDV

SEQ ID NO: 1181 - protein, 11 aa, artificial
  CDR-L1 of CDH19 14039
SGDRLGEKYTS

SEQ ID NO: 1182 - protein, 7 aa, artificial
  CDR-L2 of CDH19 14039
QDTKRPS

SEQ ID NO: 1183 - protein, 9 aa, artificial
  CDR-L3 of CDH19 14039
QAWESSTVV

SEQ ID NO: 1184 - DNA, 375 bp, artificial
  VH of CDH19 14039
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1185 - protein, 125 aa, artificial; identical to SEQ ID NO: 475
  VH of CDH19 14039

SEQ ID NO: 1186 - DNA, 318 bp, artificial
  VL of CDH19 14039
tcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1187 - protein, 106 aa, artificial
  VL of CDH19 14039
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1188 - DNA, 738 bp, artificial
  VH-VL of CDH19 14039
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1189 - protein, 246 aa, artificial
  VH-VL of CDH19 14039
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1190 - protein, 507 aa, artificial
  CDH19 14039 x I2C
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1191 - protein, 5 aa, artificial
  CDR-H1 of CDH19 14304
SYGMH

SEQ ID NO: 1192 - protein, 17 aa, artificial
  CDR-H2 of CDH19 14304
FIWYDGSNKYYADSVKD

SEQ ID NO: 1193 - protein, 16 aa, artificial
  CDR-H3 of CDH19 14304
RAGIIGTIGYYYGMDV

SEQ ID NO: 1194 - protein, 11 aa, artificial
  CDR-L1 of CDH19 14304
SGDRLGEKYVS

SEQ ID NO: 1195 - protein, 7 aa, artificial
  CDR-L2 of CDH19 14304
QDNKWPS

SEQ ID NO: 1196 - protein, 9 aa, artificial
  CDR-L3 of CDH19 14304
QAWDSSTVV

SEQ ID NO: 1197 - DNA, 375 bp, artificial
  VH of CDH19 14304
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1198 - protein, 125 aa, artificial; identical to SEQ ID NO: 543
  VH of CDH19 14304

SEQ ID NO: 1199 - DNA, 318 bp, artificial
  VL of CDH19 14304
tcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1200 - protein, 106 aa, artificial
  VL of CDH19 14304
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVL

SEQ ID NO: 1201 - DNA, 738 bp, artificial
  VH-VL of CDH19 14304
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1202 - protein, 246 aa, artificial
  VH-VL of CDH19 14304
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVL

SEQ ID NO: 1203 - protein, 507 aa, artificial
  CDH19 14304 x I2C
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1204 - protein, 5 aa, artificial
  CDR-H1 of CDH19 14301
SYGMH

SEQ ID NO: 1205 - protein, 17 aa, artificial
  CDR-H2 of CDH19 14301
FIWYDGSNKYYADSVKD

SEQ ID NO: 1206 - protein, 16 aa, artificial
  CDR-H3 of CDH19 14301
RAGIIGTIGYYYGMDV

SEQ ID NO: 1207 - protein, 11 aa, artificial
  CDR-L1 of CDH19 14301
SGDRLGEKYTC

SEQ ID NO: 1208 - protein, 7 aa, artificial
  CDR-L2 of CDH19 14301
QDTKRPS

SEQ ID NO: 1209 - protein, 9 aa, artificial
  CDR-L3 of CDH19 14301
QAWESSTVV

SEQ ID NO: 1210 - DNA, 375 bp, artificial
  VH of CDH19 14301
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1211 - protein, 125 aa, artificial; identical to SEQ ID NO: 384
  VH of CDH19 14301

SEQ ID NO: 1212 - DNA, 318 bp, artificial
  VL of CDH19 14301
tcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1213 - protein, 106 aa, artificial
  VL of CDH19 14301
SYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVL

SEQ ID NO: 1214 - DNA, 738 bp, artificial
  VH-VL of CDH19 14301
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatacttgctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1215 - protein, 246 aa, artificial
  VH-VL of CDH19 14301
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVL

SEQ ID NO: 1216 - protein, 507 aa, artificial
  CDH19 14301 x I2C
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTCWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1217 - protein, 5 aa, artificial
  CDR-H1 of CDH19 14079
RYGIH

SEQ ID NO: 1218 - protein, 17 aa, artificial
  CDR-H2 of CDH19 14079
VIWYEGSNKYYAESVKG

SEQ ID NO: 1219 - protein, 16 aa, artificial
  CDR-H3 of CDH19 14079
RAGIPGTTGYYYGMDV

SEQ ID NO: 1220 - protein, 11 aa, artificial
  CDR-L1 of CDH19 14079
SGDRLGEKYVS

SEQ ID NO: 1221 - protein, 7 aa, artificial
  CDR-L2 of CDH19 14079
QDNKWPS

SEQ ID NO: 1222 - protein, 9 aa, artificial
  CDR-L3 of CDH19 14079
QAWESSTVV

SEQ ID NO: 1223 - DNA, 375 bp, artificial
  VH of CDH19 14079
caggtgcagctggtggagtctgggggaggcgtggtccagcctggggggtccctgagactctcctgtgcagcgtctggattcaccttcagtcgctatggcatacactgggtccgccaggctccaggcaaggggctggagtgggtggcagttatatggtatgagggaagtaataaatactatgcagagtccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctca

SEQ ID NO: 1224 - protein, 125 aa, artificial; identical to SEQ ID NO: 515
  VH of CDH19 14079

SEQ ID NO: 1225 - DNA, 318 bp, artificial
  VL of CDH19 14079
tcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggagagcagcactgtggtattcggcggggggaccaagctgaccgtccta

SEQ ID NO: 1226 - protein, 106 aa, artificial
  VL of CDH19 14079
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVL

SEQ ID NO: 1227 - DNA, 738 bp, artificial
  VH-VL of CDH19 14079
caggtgcagctggtggagtctgggggaggcgtggtccagcctggggggtccctgagactctcctgtgcagcgtctggattcaccttcagtcgctatggcatacactgggtccgccaggctccaggcaaggggctggagtgggtggcagttatatggtatgagggaagtaataaatactatgcagagtccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctcaggtggcggaggatctggcggaggtggaagcggaggcggcggatcttcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggagagcagcactgtggtattcggcggggggaccaagctgaccgtccta

SEQ ID NO: 1228 - protein, 246 aa, artificial
  VH-VL of CDH19 14079
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVL

SEQ ID NO: 1229 - protein, 507 aa, artificial
  CDH19 14079 x I2C
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1230 - protein, 5 aa, artificial
  CDR-H1 of CDH19  14077
RYGIH

SEQ ID NO: 1231 - protein, 17 aa, artificial
  CDR-H2 of CDH19 14077
VIWYDGSNKYYADSVKG

SEQ ID NO: 1232 - protein, 16 aa, artificial
  CDR-H3 of CDH19 14077
RAGIPGTTGYYYGMDV

SEQ ID NO: 1233 - protein, 11 aa, artificial
  CDR-L1 of CDH19 14077
SGDRLGEKYVS

SEQ ID NO: 1234 - protein, 7 aa, artificial
  CDR-L2 of CDH19 14077
QDNKWPS

SEQ ID NO: 1235 - protein, 9 aa, artificial
  CDR-L3 of CDH19 14077
QAWDSSTVV

SEQ ID NO: 1236 - DNA, 375 bp, artificial
  VH of CDH19 14077
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctca

SEQ ID NO: 1237 - protein, 125 aa, artificial; identical to SEQ ID NO: 513
  VH of CDH19 14077

SEQ ID NO: 1238 - DNA, 318 bp, artificial; identical to SEQ ID NO: 1199
  VL of CDH19 14077

SEQ ID NO: 1239 - protein, 106 aa, artificial; identical to SEQ ID NO: 1200
  VL of CDH19 14077

SEQ ID NO: 1240 - DNA, 738 bp, artificial
  VH-VL of CDH19 14077
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctcaggtggcggaggatctggcggaggtggaagcggaggcggcggatcttcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1241 - protein, 246 aa, artificial
  VH-VL of CDH19 14077
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVL

SEQ ID NO: 1242 - protein, 507 aa, artificial
  CDH19 14077 x I2C
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1243 - protein, 5 aa, artificial
  CDR-H1 of CDH19 14096
SYYIH

SEQ ID NO: 1244 - protein, 17 aa, artificial
  CDR-H2 of CDH19 14096
IINPSGGSTRYAQKFQG

SEQ ID NO: 1245 - protein, 11 aa, artificial
  CDR-H3 of CDH19 14096
GGIQLWLHFDY

SEQ ID NO: 1246 - protein, 13 aa, artificial
  CDR-L1 of CDH19 14096
SGSSSNIGRNFVN

SEQ ID NO: 1247 - protein, 7 aa, artificial
  CDR-L2 of CDH19 14096
TNNQRPS

SEQ ID NO: 1248 - protein, 11 aa, artificial
  CDR-L3 of CDH19 14096
AAWDESLNGWV

SEQ ID NO: 1249 - DNA, 360 bp, artificial
  VH of CDH19 14096
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtctacatggagctgagcagcctgagatctgaggacacggccgtgtattactgtgcgcgagggggaatacagctatggttacattttgactactggggccagggaaccctggtcaccgtctcctca

SEQ ID NO: 1250 - protein, 120 aa, artificial; identical to SEQ ID NO: 531
  VH of CDH19 14096

SEQ ID NO: 1251 - DNA, 330 bp, artificial
  VL of CDH19 14096
cagtctgcgctgactcagccaccctcagcgactgggacccccgggcagagggtcaccatctcttgttctggaagcagctccaacatcggaaggaattttgtaaactggtatcagcagctcccaggaacggcccccaaagtcctcatttatactaataatcagcggccctcaggggtccctgaccgattctctggctccaagtctggcacctcagcctccctggccatcagtgggctccagtctgaggatgaggctgattattactgtgcagcatgggatgagagcctgaatggttgggtgttcggcggagggaccaagctgaccgtccta

SEQ ID NO: 1252 - protein, 110 aa, artificial
  VL of CDH19 14096
QSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVL

SEQ ID NO: 1253 - DNA, 735 bp, artificial
  VH-VL of CDH19 14096
caggtgcagctggtgcagtctggggctgaggtgaagaagcctggggcctcagtgaaggtttcctgcaaggcatctggatacaccttcaccagctactatattcactgggtgcgccaggcccctggacaaggacttgagtggatgggaataatcaaccccagtggtggtagcacaaggtacgcacagaagttccagggcagagtcaccatgaccagggacacgtccacgagcacagtctacatggagctgagcagcctgagatctgaggacacggccgtgtattactgtgcgcgagggggaatacagctatggttacattttgactactggggccagggaaccctggtcaccgtctcctcaggtggcggaggatctggcggaggtggaagcggaggcggcggatctcagtctgcgctgactcagccaccctcagcgactgggacccccgggcagagggtcaccatctcttgttctggaagcagctccaacatcggaaggaattttgtaaactggtatcagcagctcccaggaacggcccccaaagtcctcatttatactaataatcagcggccctcaggggtccctgaccgattctctggctccaagtctggcacctcagcctccctggccatcagtgggctccagtctgaggatgaggctgattattactgtgcagcatgggatgagagcctgaatggttgggtgttcggcggagggaccaagctgaccgtccta

SEQ ID NO: 1254 - protein, 245 aa, artificial
  VH-VL of CDH19 14096
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSSGGGGSGGGGSGGGGSQSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVL

SEQ ID NO: 1255 - protein, 506 aa, artificial
  CDH19 14096 x I2C
QVQLVQSGAEVKKPGASVKVSCKASGYTFTSYYIHWVRQAPGQGLEWMGIINPSGGSTRYAQKFQGRVTMTRDTSTSTVYMELSSLRSEDTAVYYCARGGIQLWLHFDYWGQGTLVTVSSGGGGSGGGGSGGGGSQSALTQPPSATGTPGQRVTISCSGSSSNIGRNFVNWYQQLPGTAPKVLIYTNNQRPSGVPDRFSGSKSGTSASLAISGLQSEDEADYYCAAWDESLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1256 - protein, 5 aa, artificial
  CDR-H1 of CDH19 14088
SYYMS

SEQ ID NO: 1257 - protein, 17 aa, artificial
  CDR-H2 of CDH19 14088
IIHPSGGDTTYAQKFQG

SEQ ID NO: 1258 - protein, 11 aa, artificial
  CDR-H3 of CDH19 14088
GGIKLWLHFDY

SEQ ID NO: 1259 - protein, 13 aa, artificial
  CDR-L1 of CDH19 14088
SGSRSNIGSNFVN

SEQ ID NO: 1260 - protein, 7 aa, artificial
  CDR-L2 of CDH19 14088
TNNQRPS

SEQ ID NO: 1261 - protein, 11 aa, artificial
  CDR-L3 of CDH19 14088
AVWDDSLNGWV

SEQ ID NO: 1262 - DNA, 360 bp, artificial
  VH of CDH19 14088
caggtgcagttggtgcagtctggggctgaggtgaagaagcctggggcctcagtgaaggtttcctgtaaggcatctggatacaccttcaccagctactatatgtcctgggtgcgacaggcccctggacaagggcttgagtggatgggaataatccaccctagtggtggtgacacaacctacgcacagaagttccagggcagagtcaccatgaccagggacacgtccacgagcacagtctacatggagctgagcagcctgagatctgaggacacggccgtgtattactgtgcgagaggggggataaaactatggttacattttgactattggggccagggaaccctggtcaccgtctcctca

SEQ ID NO: 1263 - protein, 120 aa, artificial; identical to SEQ ID NO: 524
  VH of CDH19 14088

SEQ ID NO: 1264 - DNA, 330 bp, artificial
  VL of CDH19 14088
cagtctgtgctgactcagccaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtccta

SEQ ID NO: 1265 - protein, 110 aa, artificial
  VL of CDH19 14088
QSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVL

SEQ ID NO: 1266 - DNA, 735 bp, artificial
  VH-VL of CDH19 14088
caggtgcagttggtgcagtctggggctgaggtgaagaagcctggggcctcagtgaaggtttcctgtaaggcatctggatacaccttcaccagctactatatgtcctgggtgcgacaggcccctggacaagggcttgagtggatgggaataatccaccctagtggtggtgacacaacctacgcacagaagttccagggcagagtcaccatgaccagggacacgtccacgagcacagtctacatggagctgagcagcctgagatctgaggacacggccgtgtattactgtgcgagaggggggataaaactatggttacattttgactattggggccagggaaccctggtcaccgtctcctcaggtggcggaggatctggcggaggtggaagcggaggcggcggatctcagtctgtgctgactcagccaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatgggatgacagcctgaatggttgggtgttcggcggagggaccaagctgaccgtccta

SEQ ID NO: 1267 - protein, 245 aa, artificial
  VH-VL of CDH19 14088
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVL

SEQ ID NO: 1268 - protein, 506 aa, artificial
  CDH19 14088 x I2C
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1269 - protein, 5 aa, artificial
  CDR-H1 of CDH19 14085
SYYMS

SEQ ID NO: 1270 - protein, 17 aa, artificial
  CDR-H2 of CDH19 14085
IIHPSGGDTTYAQKFQG

SEQ ID NO: 1271 - protein, 11 aa, artificial
  CDR-H3 of CDH19 14085
GGIKLWLHFDY

SEQ ID NO: 1272 - protein, 13 aa, artificial
  CDR-L1 of CDH19 14085
SGSRSNIGSNFVN

SEQ ID NO: 1273 - protein, 7 aa, artificial
  CDR-L2 of CDH19 14085
TNNQRPS

SEQ ID NO: 1274 - protein, 11 aa, artificial
  CDR-L3 of CDH19 14085
AVYDDSLNGWV

SEQ ID NO: 1275 - DNA, 360 bp, artificial; identical to SEQ ID NO: 371
  VH of CDH19 14085

SEQ ID NO: 1276 - protein, 120 aa, artificial; identical to SEQ ID NO: 372
  VH of CDH19 14085

SEQ ID NO: 1277 - DNA, 330 bp, artificial
  VL of CDH19 14085
cagtctgtgctgactcagccaccctcagcgtctgggacccccggacagagggtcaccatctcttgttctggaagccgctccaacatcggaagtaattttgtaaactggtaccagcagctcccaggaacggcccccaaactcctcatctatactaataatcagcggccctcaggggtccctgaccgattctctggctccaagtctggcacctcagcctccctggccatcagtgggctccagtctgaggatgaggctgattattactgtgcagtatacgatgacagcctgaatggttgggtgttcggcggagggaccaagctgaccgtccta

SEQ ID NO: 1278 - protein, 110 aa, artificial
  VL of CDH19 14085
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVL

SEQ ID NO: 1279 - protein, 735 aa, artificial
  VH-VL of CDH19 14085
CAGGTGCAGTTGGTGCAGTCTGGGGCTGAGGTGAAGAAGCCTGGGGCCTCAGTGAAGGTTTCCTGTAAGGCATCTAGATACACCTTCACCAGCTACTATATGTCCTGGGTGCGACAGGCCCCTGGACAAGGGCTTGAGTGGATGGGAATAATCCACCCTAGTGGTGGTGACACAACCTACGCACAGAAGTTCCAGGGCAGAGTCACCATGACCGGGGACACGTCCACGAGCACAGTCTACATGGAGCTGAGCAGCCTGAGATCTGAGGACACGGCCGTGTATTACTGTGCGAGAGGGGGGATAAAACTATGGTTACATTTTGACTATTGGGGCCAGGGAACCCTGGTCACCGTCTCCTCAGGTGGCGGAGGATCTGGCGGAGGTGGAAGCGGAGGCGGCGGATCTCAGTCTGTGCTGACTCAGCCACCCTCAGCGTCTGGGACCCCCGGACAGAGGGTCACCATCTCTTGTTCTGGAAGCCGCTCCAACATCGGAAGTAATTTTGTAAACTGGTACCAGCAGCTCCCAGGAACGGCCCCCAAACTCCTCATCTATACTAATAATCAGCGGCCCTCAGGGGTCCCTGACCGATTCTCTGGCTCCAAGTCTGGCACCTCAGCCTCCCTGGCCATCAGTGGGCTCCAGTCTGAGGATGAGGCTGATTATTACTGTGCAGTATACGATGACAGCCTGAATGGTTGGGTGTTCGGCGGAGGGACCAAGCTGACCGTCCTA

SEQ ID NO: 1280 - protein, 245 aa, artificial
  VH-VL of CDH19 14085
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVL

SEQ ID NO: 1281 - protein, 506 aa, artificial
  CDH19 14085 x I2C
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1282 - protein, 5 aa, artificial
  CDR-H1 of CDH19 14074
SYFIH

SEQ ID NO: 1283 - protein, 17 aa, artificial
  CDR-H2 of CDH19 14074
IINPISVSTSYAQKFQG

SEQ ID NO: 1284 - protein, 11 aa, artificial
  CDR-H3 of CDH19 14074
GGIQLWLHLDY

SEQ ID NO: 1285 - protein, 13 aa, artificial
  CDR-L1 of CDH19 14074
SGSRSNIGSNFVN

SEQ ID NO: 1286 - protein, 7 aa, artificial
  CDR-L2 of CDH19 14074
TNNQRPS

SEQ ID NO: 1287 - protein, 11 aa, artificial
  CDR-L3 of CDH19 14074
ATWDDSMNGWV

SEQ ID NO: 1288 - DNA, 360 bp, artificial; identical to SEQ ID NO: 367
  VH of CDH19 14074

SEQ ID NO: 1289 - protein, 120 aa, artificial; identical to SEQ ID NO: 368
  VH of CDH19 14074

SEQ ID NO: 1290 - DNA, 330 bp, artificial
  VL of CDH19 14074
cagtctgcgctgactcagccaccctcagtgactgggacccccgggcagagggtcaccatctcttgttctggaagcaggtccaacatcggaagcaattttgtaaactggtaccagcagctcccaggaacggcccccaaagtcctcatctatactaataatcagcggccctcaggggtccctgaccgattctctggctccaagtctggcacctcagcctccctggccatcagtgggctccagtctgaggatgaggctgattattactgcgcaacatgggatgacagtatgaatggttgggtgttcggcggagggaccaaactgaccgtccta

SEQ ID NO: 1291 - protein, 110 aa, artificial
  VL of CDH19 14074
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVL

SEQ ID NO: 1292 - DNA, 735 bp, artificial
  VH-VL of CDH19 14074
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcaggtggcggaggatctggcggaggtggaagcggaggcggcggatctcagtctgcgctgactcagccaccctcagtgactgggacccccgggcagagggtcaccatctcttgttctggaagcaggtccaacatcggaagcaattttgtaaactggtaccagcagctcccaggaacggcccccaaagtcctcatctatactaataatcagcggccctcaggggtccctgaccgattctctggctccaagtctggcacctcagcctccctggccatcagtgggctccagtctgaggatgaggctgattattactgcgcaacatgggatgacagtatgaatggttgggtgttcggcggagggaccaaactgaccgtccta

SEQ ID NO: 1293 - protein, 245 aa, artificial
  VH-VL of CDH19 14074
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVL

SEQ ID NO: 1294 - protein, 506 aa, artificial
  CDH19 14074 x I2C
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1295 - protein, 5 aa, artificial
  CDR-H1 of CDH19  14075
SYFIH

SEQ ID NO: 1296 - protein, 17 aa, artificial
  CDR-H2 of CDH19 14075
IINPISVSTSYAQKFQG

SEQ ID NO: 1297 - protein, 11 aa, artificial
  CDR-H3 of CDH19 14075
GGIQLWLHLDY

SEQ ID NO: 1298 - protein, 13 aa, artificial
  CDR-L1 of CDH19 14075
SGSRSNIGSNFVN

SEQ ID NO: 1299 - protein, 7 aa, artificial
  CDR-L2 of CDH19 14075
TNNQRPS

SEQ ID NO: 1300 - protein, 11 aa, artificial
  CDR-L3 of CDH19 14075
ATWDESMQGWV

SEQ ID NO: 1301 - DNA, 360 bp, artificial; identical to SEQ ID NO: 367
  VH of CDH19 14075

SEQ ID NO: 1302 - protein, 120 aa, artificial; identical to SEQ ID NO: 368
  VH of CDH19 14075

SEQ ID NO: 1303 - DNA, 330 bp, artificial
  VL of CDH19  14075
cagtctgcgctgactcagccaccctcagtgactgggacccccgggcagagggtcaccatctcttgttctggaagcaggtccaacatcggaagcaattttgtaaactggtaccagcagctcccaggaacggcccccaaagtcctcatctatactaataatcagcggccctcaggggtccctgaccgattctctggctccaagtctggcacctcagcctccctggccatcagtgggctccagtctgaggatgaggctgattattactgcgcaacatgggatgagagtatgcagggttgggtgttcggcggagggaccaaactgaccgtccta

SEQ ID NO: 1304 - protein, 110 aa, artificial
  VL of CDH19  14075
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVL

SEQ ID NO: 1305 - DNA, 735 bp, artificial
  VH-VL of CDH19  14075
caggtgcagttggtgcagtctggggctgaggtgaagaagcctggggcctcagtgaaggtttcctgcaaggtttctggatacaccttcaccagctactttattcactgggtgcgccaggcccctggacaagggcttgaatggatgggaattatcaaccctattagtgttagcacaagctacgcacagaagttccagggcagagtcaccatgaccagggacacgtccacgagcacagtcttcatggagctgagcagcctgagatctgaggacacggccgtgtattactgtgcgcgaggggggatacagctatggttacatttggactactggggccagggaaccctggtcaccgtctcctcaggtggcggaggatctggcggaggtggaagcggaggcggcggatctcagtctgcgctgactcagccaccctcagtgactgggacccccgggcagagggtcaccatctcttgttctggaagcaggtccaacatcggaagcaattttgtaaactggtaccagcagctcccaggaacggcccccaaagtcctcatctatactaataatcagcggccctcaggggtccctgaccgattctctggctccaagtctggcacctcagcctccctggccatcagtgggctccagtctgaggatgaggctgattattactgcgcaacatgggatgagagtatgcagggttgggtgttcggcggagggaccaaactgaccgtccta

SEQ ID NO: 1306 - protein, 245 aa, artificial
  VH-VL of CDH19  14075
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVL

SEQ ID NO: 1307 - protein, 506 aa, artificial
  CDH19 14075 x I2C
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1308 - protein, 5 aa, artificial
  CDR-H1 of CDH19 14024
SSGYY

SEQ ID NO: 1309 - protein, 16 aa, artificial
  CDR-H2 of CDH19 14024
YIYYTGSAYYNPSLKS

SEQ ID NO: 1310 - protein, 10 aa, artificial
  CDR-H3 of CDH19 14024
DGSSGWYFQY

SEQ ID NO: 1311 - protein, 12 aa, artificial
  CDR-L1 of CDH19 14024
RASRQISSSYLA

SEQ ID NO: 1312 - protein, 7 aa, artificial
  CDR-L2 of CDH19 14024
GPSSRAT

SEQ ID NO: 1313 - protein, 8 aa, artificial
  CDR-L3 of CDH19 14024
QQYGSSFT

SEQ ID NO: 1314 - DNA, 360 bp, artificial
  VH of CDH19 14024
caggtgcagctgcaggagtcgggcccaggactggtgaagccttcagagaccctgtccctcacctgcactgtctctggtggctccatcagcagtagtggttactactggagctggatccgccagcccccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctctagt

SEQ ID NO: 1315 - protein, 120 aa, artificial; identical to SEQ ID NO: 464
  VH of CDH19 14024

SEQ ID NO: 1316 - DNA, 321 bp, artificial
  VL of CDH19 14024
gaaattgtgttgacgcagtctccaggcaccctgtctttgtctccaggggaaagagccaccctctcctgcagggccagtcggcagattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttgcagtgtattactgtcagcagtatggtagctcattcactttcggccaggggaccaaagtggatatcaaa

SEQ ID NO: 1317 - protein, 107 aa, artificial
  VL of CDH19 14024
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIK

SEQ ID NO: 1318 - DNA, 726 bp, artificial
  VH-VL of CDH19
caggtgcagctgcaggagtcgggcccaggactggtgaagccttcagagaccctgtccctcacctgcactgtctctggtggctccatcagcagtagtggttactactggagctggatccgccagcccccagggaagggcctggagtggattgggtacatctattacactgggagcgcctactacaacccgtccctcaagagtcgagttaccatatcagtagacacgtctaagaaccagttctccctgaagctgagctctgtgactgccgcggacacggccgtgtattactgtgcgagagatggaagcagtggctggtacttccagtattggggccagggcaccctggtcaccgtctctagtggtggcggaggatctggcggaggtggaagcggaggcggcggatctgaaattgtgttgacgcagtctccaggcaccctgtctttgtctccaggggaaagagccaccctctcctgcagggccagtcggcagattagcagcagctacttagcctggtaccagcagaaacctggccaggctcccaggctcctcatctatggtccatccagcagggccactggcatcccagacaggttcagtggcagtgggtctgggacagacttcactctcaccatcagcagactggagcctgaagattttgcagtgtattactgtcagcagtatggtagctcattcactttcggccaggggaccaaagtggatatcaaa

SEQ ID NO: 1319 - protein, 242 aa, artificial
  VH-VL of CDH19
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSGGGGSGGGGSGGGGSEIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIK

SEQ ID NO: 1320 - protein, 503 aa, artificial
  CDH19 14024 x I2C
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSGGGGSGGGGSGGGGSEIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1321 - protein, 5 aa, artificial
  CDR-H1 of CDH19 14054
SYDMH

SEQ ID NO: 1322 - protein, 17 aa, artificial
  CDR-H2 of CDH19 14054
VISYDGTNEYYADSVKG

SEQ ID NO: 1323 - protein, 10 aa, artificial
  CDR-H3 of CDH19 14054
ERYFDWSFDY

SEQ ID NO: 1324 - protein, 12 aa, artificial
  CDR-L1 of CDH19 14054
RASQSVSNTYLA

SEQ ID NO: 1325 - protein, 7 aa, artificial
  CDR-L2 of CDH19 14054
GASSRAT

SEQ ID NO: 1326 - protein, 8 aa, artificial
  CDR-L3 of CDH19 14054
QQYSNSWT

SEQ ID NO: 1327 - DNA, 357 bp, artificial
  VH of CDH19 14054
caggtgcagctggtggagtctgggggaggcgtggtccagcctggggggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagcgtctctagt

SEQ ID NO: 1328 - protein, 119 aa, artificial; identical to SEQ ID NO: 490
  VH of CDH19 14054

SEQ ID NO: 1329 - DNA, 321 bp, artificial
  VL of CDH19 14054
gaaattgtattgacgcagtctccaggcaccctgtctttgtctccaggggaaagagccaccctctcctgcagggccagtcagagtgttagcaacacctacttagcctggtaccagcagagacctggccaggctcccaggctcctcatctatggtgcatccagcagggccactggcatcccagacagattcagtggcagtgggtctgggacagacttcactctcaccatcagcagtctggagcctgaagattttgcagtgtattactgtcagcagtacagtaactcgtggacgttcggccaagggaccaaggtggaaatcaaa

SEQ ID NO: 1330 - protein, 107 aa, artificial
  VL of CDH19 14054
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIK

SEQ ID NO: 1331 - DNA, 723 bp, artificial
  VH-VL of CDH19 14054
caggtgcagctggtggagtctgggggaggcgtggtccagcctggggggtccctgagactctcctgtgcagcctctggattcaccttcagtagctatgacatgcactgggtccgccaggctccaggcaaggggctggagtgggtggcagttatatcatatgatggaactaatgaatactatgcagactccgtgaagggccgattcaccatctccagagacacttccaagaacacgctgtatttgcaaatgaacagcctgagagctgaggacacggctgtatattactgtgcgagagaacgatattttgactggtcttttgactactggggccagggaaccctggtcagcgtctctagtggtggcggaggatctggcggaggtggaagcggaggcggcggatctgaaattgtattgacgcagtctccaggcaccctgtctttgtctccaggggaaagagccaccctctcctgcagggccagtcagagtgttagcaacacctacttagcctggtaccagcagagacctggccaggctcccaggctcctcatctatggtgcatccagcagggccactggcatcccagacagattcagtggcagtgggtctgggacagacttcactctcaccatcagcagtctggagcctgaagattttgcagtgtattactgtcagcagtacagtaactcgtggacgttcggccaagggaccaaggtggaaatcaaa

SEQ ID NO: 1332 - protein, 241 aa, artificial
  VH-VL of CDH19 14054
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIK

SEQ ID NO: 1333 - protein, 502 aa, artificial
  CDH19 14054 x I2C
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1334 - protein, 5 aa, artificial
  CDR-H1 of CDH19 14056
GYYWS

SEQ ID NO: 1335 - protein, 16 aa, artificial
  CDR-H2 of CDH19 14056
YFSYSGSTNYNPSLKS

SEQ ID NO: 1336 - protein, 8 aa, artificial
  CDR-H3 of CDH19 14056
NWAFHFDF

SEQ ID NO: 1337 - protein, 14 aa, artificial
  CDR-L1 of CDH19 14056
TGSSSNIGTGYAVH

SEQ ID NO: 1338 - protein, 7 aa, artificial
  CDR-L2 of CDH19 14056
GNNNRPS

SEQ ID NO: 1339 - protein, 11 aa, artificial
  CDR-L3 of CDH19 14056
QSYDSRLSGWV

SEQ ID NO: 1340 - DNA, 348 bp, artificial
  VH of CDH19 14056
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagt

SEQ ID NO: 1341 - protein, 116 aa, artificial; identical to SEQ ID NO: 362
  VH of CDH19 14056

SEQ ID NO: 1342 - DNA, 333 bp, artificial
  VL of CDH19 14056
cagtctgtgctgacgcagccgccctcagtgtctggggccccaggacagagggtcaccatctcctgcactgggagcagctccaacatcgggacaggttatgctgtacactggtaccagcagcttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtccta

SEQ ID NO: 1343 - protein, 111 aa, artificial
  VL of CDH19 14056
QSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVL

SEQ ID NO: 1344 - DNA, 726 bp, artificial
  VH-VL of CDH19 14056
caggtgcagctgcaggagtcgggcccaggactggtgaagccttcggagaccctgtccctcacctgcactgtctctggtggctccatcagtggttactactggagctggatccggcagcccccaggaaagggactggagtggtttgcatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagtggtggcggaggatctggcggaggtggaagcggaggcggcggatctcagtctgtgctgacgcagccgccctcagtgtctggggccccaggacagagggtcaccatctcctgcactgggagcagctccaacatcgggacaggttatgctgtacactggtaccagcagcttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtccta

SEQ ID NO: 1345 - protein, 242 aa, artificial
  VH-VL of CDH19 14056
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVL

SEQ ID NO: 1346 - protein, 503 aa, artificial
  CDH19 14056 x I2C
QVQLQESGPGLVKPSETLSLTCTVSGGSISGYYWSWIRQPPGKGLEWFAYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1347 - protein, 5 aa, artificial
  CDR-H1 of CDH19 14057
GYYWS

SEQ ID NO: 1348 - protein, 16 aa, artificial
  CDR-H2 of CDH19 14057
YFSYSGSTNYNPSLKS

SEQ ID NO: 1349 - protein, 8 aa, artificial
  CDR-H3 of CDH19 14057
NWAFHFDF

SEQ ID NO: 1350 - protein, 14 aa, artificial
  CDR-L1 of CDH19 14057
TGSSSNIGTGYAVH

SEQ ID NO: 1351 - protein, 7 aa, artificial
  CDR-L2 of CDH19 14057
GNNNRPS

SEQ ID NO: 1352 - protein, 11 aa, artificial
  CDR-L3 of CDH19 14057
QSYDSRLSGWV

SEQ ID NO: 1353 - DNA, 348 bp, artificial
  VH of CDH19 14057
caggtgcagctgcaggagtcgggcccaggactggtgaagccttcggagaccctgtccctcacctgcactgtctctggtggctccatcagtggttactactggagctggatccggcagcccccaggaaagggactggagtggattggatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagt

SEQ ID NO: 1354 - protein, 116 aa, artificial; identical to SEQ ID NO: 493
  VH of CDH19 14057

SEQ ID NO: 1355 - DNA, 333 bp, artificial; identical to SEQ ID NO: 1342
  VL of CDH19 14057

SEQ ID NO: 1356 - protein, 111 aa, artificial; identical to SEQ ID NO: 1343
  VL of CDH19 14057

SEQ ID NO: 1357 - DNA, 726 bp, artificial
  VH-VL of CDH19 14057
caggtgcagctgcaggagtcgggcccaggactggtgaagccttcggagaccctgtccctcacctgcactgtctctggtggctccatcagtggttactactggagctggatccggcagcccccaggaaagggactggagtggattggatatttctcttacagtgggagcaccaactacaacccctccctcaagagtcgagtcaccttatcagtagacacgtccaagaaccagttctccctgaagctgagctctgtgaccgctgcggacacggccgtgtattactgtgcgaggaactgggccttccactttgacttctggggccagggaaccctggtcaccgtctctagtggtggcggaggatctggcggaggtggaagcggaggcggcggatctcagtctgtgctgacgcagccgccctcagtgtctggggccccaggacagagggtcaccatctcctgcactgggagcagctccaacatcgggacaggttatgctgtacactggtaccagcagcttccaggaacagcccccaaactcctcatctatggtaacaacaatcggccctcaggggttcctgaccgattctctggctccaagtctggcacctcagcctccctggccatcactgggctccaggctgaggatgaggctgattattactgccagtcctatgacagcagactgagtggttgggtgttcggcggagggaccaagctgaccgtccta

SEQ ID NO: 1358 - protein, 242 aa, artificial
  VH-VL of CDH19 14057
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVL

SEQ ID NO: 1359 - protein, 503 aa, artificial
  CDH19 14057 x I2C
QVQLQESGPGLVKPSETLSLTCTVSGGSISGYYWSWIRQPPGKGLEWIGYFSYSGSTNYNPSLKSRVTLSVDTSKNQFSLKLSSVTAADTAVYYCARNWAFHFDFWGQGTLVTVSSGGGGSGGGGSGGGGSQSVLTQPPSVSGAPGQRVTISCTGSSSNIGTGYAVHWYQQLPGTAPKLLIYGNNNRPSGVPDRFSGSKSGTSASLAITGLQAEDEADYYCQSYDSRLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1360 - protein, 5 aa, artificial
  CDR-H1 of CDH19 14049
SYSWS

SEQ ID NO: 1361 - protein, 16 aa, artificial
  CDR-H2 of CDH19 14049
YIYYSGSTNYNPSLKS

SEQ ID NO: 1362 - protein, 8 aa, artificial
  CDR-H3 of CDH19 14049
NWAFHFDY

SEQ ID NO: 1363 - protein, 14 aa, artificial
  CDR-L1 of CDH19 14049
TGSSSNIGTGYDVH

SEQ ID NO: 1364 - protein, 7 aa, artificial
  CDR-L2 of CDH19 14049
GNSNRPS

SEQ ID NO: 1365 - protein, 11 aa, artificial
  CDR-L3 of CDH19 14049
QSYDSSLSGWV

SEQ ID NO: 1366 - DNA, 348 bp, artificial
  VH of CDH19 14049
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctctagt

SEQ ID NO: 1367 - protein, 116 aa, artificial; identical to SEQ ID NO: 364
  VH of CDH19 14049

SEQ ID NO: 1368 - DNA, 333 bp, artificial
  VL of CDH19 14049
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtccta

SEQ ID NO: 1369 - protein, 111 aa, artificial
  VL of CDH19 14049
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVL

SEQ ID NO: 1370 - DNA, 726 bp, artificial
  VH-VL of CDH19 14049
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctctagtggtggcggaggatctggcggaggtggaagcggaggcggcggatctcagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatctatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtccta

SEQ ID NO: 1371 - protein, 242 aa, artificial
  VH-VL of CDH19 14049
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVL

SEQ ID NO: 1372 - protein, 503 aa, artificial
  CDH19 14049 x I2C
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIYGNSNRPSGVPDRFSGSKSGTSASLAITGLQAEDEADYYCQSYDSSLSGWVFGGGTRLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1373 - protein, 5 aa, artificial
  CDR-H1 of CDH19 14302
SYGMH

SEQ ID NO: 1374 - protein, 17 aa, artificial
  CDR-H2 of CDH19 14302
FIWYDGSNKYYADSVKD

SEQ ID NO: 1375 - protein, 16 aa, artificial
  CDR-H3 of CDH19 14302
RAGIIGTIGYYYGMDV

SEQ ID NO: 1376 - protein, 11 aa, artificial
  CDR-L1 of CDH19 14302
SGDRLGEKYTS

SEQ ID NO: 1377 - protein, 7 aa, artificial
  CDR-L2 of CDH19 14302
QDTKRPS

SEQ ID NO: 1378 - protein, 9 aa, artificial
  CDR-L3 of CDH19 14302
QAWESSTVV

SEQ ID NO: 1379 - DNA, 375 bp, artificial
  VH of CDH19 14302
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1380 - protein, 125 aa, artificial; identical to SEQ ID NO: 541
  VH of CDH19 14302

SEQ ID NO: 1381 - DNA, 318 bp, artificial; identical to SEQ ID NO: 1186
  VL of CDH19 14302

SEQ ID NO: 1382 - protein, 106 aa, artificial; identical to SEQ ID NO: 1187
  VL of CDH19 14302

SEQ ID NO: 1383 - DNA, 738 bp, artificial
  VH-VL of CDH19 14302
caggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1384 - protein, 246 aa, artificial
  VH-VL of CDH19 14302
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1385 - protein, 507 aa, artificial
  CDH19 14302 x I2C
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1386 - protein, 5 aa, artificial
  CDR-H1 of CDH19 14303
SYGMH

SEQ ID NO: 1387 - protein, 17 aa, artificial
  CDR-H2 of CDH19 14303
FIWYEGSNKYYAESVKD

SEQ ID NO: 1388 - protein, 16 aa, artificial
  CDR-H3 of CDH19 14303
RAGIIGTIGYYYGMDV

SEQ ID NO: 1389 - protein, 11 aa, artificial
  CDR-L1 of CDH19 14303
SGDRLGEKYTS

SEQ ID NO: 1390 - protein, 7 aa, artificial
  CDR-L2 of CDH19 14303
QDTKRPS

SEQ ID NO: 1391 - protein, 9 aa, artificial
  CDR-L3 of CDH19 14303
QAWESSTVV

SEQ ID NO: 1392 - DNA, 375 bp, artificial
  VH of CDH19 14303
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1393 - protein, 125 aa, artificial; identical to SEQ ID NO: 542
  VH of CDH19 14303

SEQ ID NO: 1394 - DNA, 318 bp, artificial; identical to SEQ ID NO: 1186
  VL of CDH19 14303

SEQ ID NO: 1395 - protein, 106 aa, artificial; identical to SEQ ID NO: 1187
  VL of CDH19 14303

SEQ ID NO: 1396 - DNA, 738 bp, artificial
  VH-VL of CDH19 14303
caggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1397 - protein, 246 aa, artificial
  VH-VL of CDH19 14303
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1398 - protein, 507 aa, artificial
  CDH19 14303 x I2C
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1399 - protein, 5 aa, artificial
  CDR-H1 of CDH19 14078
RYGIH

SEQ ID NO: 1400 - protein, 17 aa, artificial
  CDR-H2 of CDH19 14078
VIWYDGSNKYYADSVKG

SEQ ID NO: 1401 - protein, 16 aa, artificial
  CDR-H3 of CDH19 14078
RAGIPGTTGYYYGMDV

SEQ ID NO: 1402 - protein, 11 aa, artificial
  CDR-L1 of CDH19 14078
SGDRLGEKYVS

SEQ ID NO: 1403 - protein, 7 aa, artificial
  CDR-L2 of CDH19 14078
QDNKWPS

SEQ ID NO: 1404 - protein, 9 aa, artificial
  QDNKWPS
QAWDSSTVV

SEQ ID NO: 1405 - DNA, 375 bp, artificial
  VH of CDH19 14078
caggtgcagctggtggagtctgggggaggcgtggtccagcctggggggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctca

SEQ ID NO: 1406 - protein, 125 aa, artificial; identical to SEQ ID NO: 514
  VH of CDH19 14078

SEQ ID NO: 1407 - DNA, 318 bp, artificial; identical to SEQ ID NO: 1199
  VL of CDH19 14078

SEQ ID NO: 1408 - protein, 106 aa, artificial; identical to SEQ ID NO: 1200
  VL of CDH19 14078

SEQ ID NO: 1409 - DNA, 738 bp, artificial
  VH-VL of CDH19 14078
caggtgcagctggtggagtctgggggaggcgtggtccagcctggggggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgcaaatgaacagcctgagagccgaggactcggctgtgtattactgtgcgagaagggccggtatacctggaactacgggctactactatggtatggacgtctggggccaagggaccacggtcaccgtctcctcaggtggcggaggatctggcggaggtggaagcggaggcggcggatcttcctatgagctgactcagccaccctcagtgtccgtgtccccaggacagacagccagcatcacctgctctggagatagattgggggagaaatatgttagctggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1410 - protein, 246 aa, artificial
  VH-VL of CDH19 14078
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVL

SEQ ID NO: 1411 - protein, 507 aa, artificial
  CDH19 14078  x I2C
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1412 - protein, 5 aa, artificial
  CDR-H1 of CDH19 14080
RYGIH

SEQ ID NO: 1413 - protein, 17 aa, artificial
  CDR-H2 of CDH19 14080
VIWYDGSNKYYADSVKG

SEQ ID NO: 1414 - protein, 16 aa, artificial
  CDR-H3 of CDH19 14080
RAGIPGTTGYYYGMDV

SEQ ID NO: 1415 - protein, 11 aa, artificial
  CDR-L1 of CDH19 14080
SGDRLGEKYVY

SEQ ID NO: 1416 - protein, 7 aa, artificial
  CDR-L2 of CDH19 14080
QDNKWPS

SEQ ID NO: 1417 - protein, 9 aa, artificial
  CDR-L3 of CDH19 14080
QAWDSSTVV

SEQ ID NO: 1418 - DNA, 375 bp, artificial; identical to SEQ ID NO: 389
  VH of CDH19 14080

SEQ ID NO: 1419 - protein, 125 aa, artificial; identical to SEQ ID NO: 390
  VH of CDH19 14080

SEQ ID NO: 1420 - DNA, 318 bp, artificial
  VL of CDH19 14080
tcctatgagctgactcagccaccctcagtgtccgtgtccccaggacagacagccagcatcacctgctctggagatagattgggggagaaatatgtttactggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1421 - protein, 246 aa, artificial
  VL of CDH19 14080
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSGGGGSGGGGSGGGGSSYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVL

SEQ ID NO: 1422 - DNA, 738 bp, artificial
  VH-VL of CDH19 14080
caggtgcagctggtggagtctgggggaggcgtggtccagcctgggaggtccctgagactctcctgtgcagcgtctggattcaccttcagtcgctatggcatacactgggtccgccaggctccaggcaaggggctggagtgggtggcagttatatggtatgatggaagtaataaatactatgcagactccgtgaagggccgattcaccatctccagagacaattccaagaacacgctgtatctgctaatgaacagcctgagagccgaggactcggctgtgtattactgtgcgagaagggccggtatacctggaactacgggctactactatggtatggacgtctggggccaagggaccacggtcaccgtctcctcaggtggcggaggatctggcggaggtggaagcggaggcggcggatcttcctatgagctgactcagccaccctcagtgtccgtgtccccaggacagacagccagcatcacctgctctggagatagattgggggagaaatatgtttactggtatcagcagaagccaggccagtcccctatactggtcatctatcaagataataagtggccctcagggatccctgagcgattctctggctccaactctgggaacacagccactctgaccatcagcgggacccaggctatggatgaggctgactattactgtcaggcgtgggacagcagcactgtggtattcggcggggggaccaagctgaccgtccta

SEQ ID NO: 1423 - protein, 246 aa, artificial; identical to SEQ ID NO: 1421
  VH-VL of CDH19 14080

SEQ ID NO: 1424 - protein, 507 aa, artificial
  CDH19 14080 x I2C
QVQLVESGGGVVQPGRSLRLSCAASGFTFSRYGIHWVRQAPGKGLEWVAVIWYDGSNKYYADSVKGRFTISRDNSKNTLYLLMNSLRAEDSAVYYCARRAGIPGTTGYYYGMDVWGQGTTVTVSSGGGGSGGGGSGGGGSSYELTQPPSVSVSPGQTASITCSGDRLGEKYVYWYQQKPGQSPILVIYQDNKWPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1425 - protein, 5 aa, artificial
  CDR-H1 of CDH19 13591
SYSWS

SEQ ID NO: 1426 - protein, 16 aa, artificial
  CDR-H2 of CDH19 13591
YIYYSGSTNYNPSLKS

SEQ ID NO: 1427 - protein, 8 aa, artificial
  CDR-H3 of CDH19 13591
NWAFHFDY

SEQ ID NO: 1428 - protein, 14 aa, artificial
  CDR-L1 of CDH19 13591
TGSSSNIGTGYDVH

SEQ ID NO: 1429 - protein, 7 aa, artificial
  CDR-L2 of CDH19 13591
GNSNRPS

SEQ ID NO: 1430 - protein, 11 aa, artificial
  CDR-L3 of CDH19 13591
QSYDSSLSGWV

SEQ ID NO: 1431 - DNA, 348 bp, artificial; identical to SEQ ID NO: 1366
  VH of CDH19 13591

SEQ ID NO: 1432 - protein, 116 aa, artificial; identical to SEQ ID NO: 364
  VH of CDH19 13591

SEQ ID NO: 1433 - DNA, 333 bp, artificial
  VL of CDH19 13591
cagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtccta

SEQ ID NO: 1434 - protein, 111 aa, artificial; identical to SEQ ID NO: 1174
  VL of CDH19 13591

SEQ ID NO: 1435 - DNA, 726 bp, artificial
  VH-VL of CDH19 1591
caggtgcagctgcaggagtcgggcccaggactggtgaagccttcggagaccctgtccctcacctgcactgtctctggtggctccatcagtagttactcctggagctggatccggcagcccccagggaagggactggagtggattgggtatatctattacagtgggagcaccaactacaacccctccctcaagagtcgagtcaccatatcattagacacgtccaagaaccagttctccctgaagctgagctctgtgaccgctgcggacacggccgtgtattactgtgcgaggaactgggccttccactttgactactggggccagggaaccctggtcaccgtctctagtggtggcggaggatctggcggaggtggaagcggaggcggcggatctcagtctgtgctgacgcagccgccctcagtgtctggggccccagggcagagggtcaccatctcctgcactgggagcagctccaatatcgggacaggttatgatgtacactggtatcagcagcttccaggaacagcccccaaactcctcatccatggtaacagcaatcggccctcaggggtccctgaccgattctctggctccaagtctggcacctcagcctccctggccatcactgggctccaggctgaggatgaggctgattattactgccagtcctatgacagcagtctgagtggttgggtgttcggcggagggaccaggttgaccgtccta

SEQ ID NO: 1436 - protein, 242 aa, artificial; identical to SEQ ID NO: 1176
  VH-VL of CDH19 1591

SEQ ID NO: 1437 - protein, 503 aa, artificial; identical to SEQ ID NO: 1177
  CDH19 13591 x I2C

SEQ ID NO: 1438 - protein, 5 aa, artificial
  CDR-H1 of CDH19 14299
SYSWS

SEQ ID NO: 1439 - protein, 16 aa, artificial
  CDR-H2 of CDH19 14299
YIYYSGSTNYNPSLKS

SEQ ID NO: 1440 - protein, 8 aa, artificial
  CDR-H3 of CDH19 14299
NWAFHFDY

SEQ ID NO: 1441 - protein, 14 aa, artificial
  CDR-L1 of CDH19 14299
TGSSSNIGTGYDVH

SEQ ID NO: 1442 - protein, 7 aa, artificial
  CDR-L2 of CDH19 14299
GNSNRPS

SEQ ID NO: 1443 - protein, 11 aa, artificial
  CDR-L3 of CDH19 14299
QSYDSSLSGWV

SEQ ID NO: 1444 - DNA, 348 bp, artificial; identical to SEQ ID NO: 1366
  VH of CDH19 14299

SEQ ID NO: 1445 - protein, 116 aa, artificial; identical to SEQ ID NO: 364
  VH of CDH19 14299

SEQ ID NO: 1446 - DNA, 333 bp, artificial; identical to SEQ ID NO: 1433
  VL of CDH19 14299

SEQ ID NO: 1447 - protein, 111 aa, artificial; identical to SEQ ID NO: 1174
  VL of CDH19 14299

SEQ ID NO: 1448 - DNA, 726 bp, artificial; identical to SEQ ID NO: 1435
  VH-VL of CDH19 14299

SEQ ID NO: 1449 - protein, 242 aa, artificial; identical to SEQ ID NO: 1176
  VH-VL of CDH19 14299

SEQ ID NO: 1450 - protein, 503 aa, artificial; identical to SEQ ID NO: 1177
  CDH19 14299 x I2C

SEQ ID NO: 1451 - protein, 784 aa, artificial
  ckCDH19(1-43)::FLAG::ckCDH19(44-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1452 - protein, 784 aa, artificial
  huCDH19(1-43)::FLAG::hu(44-141)::ckCDH19(142-776)
MNCYLLLRFMLGIPLLWPCLGATENSQTKKVKQPVRSHLRVKRDYKDDDDKGWVWNQFFVPEEMNTTSHHIGQLRSDLDNGNNSFQYKLLGAGAGSTFIIDERTGDIYAIQKLDREERSLYILRAQVIDIATGRAVEPESEFVIKVSDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1453 - protein, 784 aa, artificial
  ckCDH19(1-43)::FLAG::ckCDH19(44-141)::huCDH19(142-249)::ckCDH19(2 50-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1454 - protein, 784 aa, artificial
  ckCDH19(1-43)::FLAG::ckCDH19(44-249)::huCDH19(250-364)::ckCDH19(3 65-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNKPIFKESLYRLTVSESAPTGTSIGTIMAYDNDIGENAEMDYSIEEDDSQTFDIITNHETQEGIVILKKKVDFEHQNHYGIRAKVKNHHVPEQLMKYHTEASTTFIKIQVEDVDEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1455 - protein, 779 aa, artificial
  ckCDH19(1-43)::FLAG::ckCDH19(44-364)::huCDH19(365-463)::ckCDH19(4 69-776)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPLFLLPYYVFEVFEETPQGSFVGVVSATDPDNRKSPIRYSITRSKVFNINDNGTITTSNSLDREISAWYNLSITATEKYNIEQISSIPLYVQVLNINDHAPEFSKYYETFVCENAVPGQLIQNISAVDKDDSAENHRFYFSLAQATNSSHFTVKDNQDNTAGIFTAGSGFSRKEQFYFFLPILILDNGSPPLTSTNTLTVTVCDCDTEVNTLYCRYGAFLYSIGLSTEALVAVLACLLILLVFFLAIIGIRQQRKKTLFSEKVEEFRENIVRYDDEGGGEEDTEAFDISALRTRAVLRTHKPRKKITTEIHSLYRQSLQVGPDSAIFRQFISEKLEEANTDPSVPPYDSLQTYAFEGTGSLAGSLSSLGSNTSDVDQNYEYLVGWGPPFKQLAGMYTSQRSTRD

SEQ ID NO: 1456 - protein, 785 aa, artificial
  (1-43)::FLAG::ckCDH19(44-468)::huCDH19(464-772)
MNCSTFLSLVLALVQLQLCSPTTQIFSAQKTDQSYTTIRRVKRDYKDDDDKGWVWEPLFVTEEETSTMPMYVGQLKSDLDKEDGSLQYILTGEGADSIFFINEHGKIYVRQKLDREKKSFYILRAQVINRKTRHPIEPDSEFIIKVRDINDHEPQFLDGPYVATVPEMSPEGTSVTQVTATDGDDPSYGNNARLLYSLIQGQPYFSVEPKTGVIRMTSQMDRETKDQYLVVIQAKDMVGQAGAFSATATVTINLSDVNDNPPKFQQRLYYLNVSEEAPVGTTVGRLLAEDSDIGENAAMNYFIEEDSSDVFGIITDRETQEGIIILKKRVDYESKRKHSVRVKAVNRYIDDRFLKEGPFEDITIVQISVVDADEPPVFTLESYVMEIAEGVVSGSLVGTVSARDLDNDDSSVRYSIVQGLHLKRLFSINEHNGTIITTEPLDREKASWHNITVTATETRNPEKISEANVYIQVLDVNDHAPEFSQYYETYVCENAGSGQVIQTISAVDRDESIEEHHFYFNLSVEDTNNSSFTIIDNQDNTAVILTNRTGFNLQEEPVFYISILIADNGIPSLTSTNTLTIHVCDCGDSGSTQTCQYQELVLSMGFKTEVIIAILICIMIIFGFIFLTLGLKQRRKQILFPEKSEDFRENIFQYDDEGGGEEDTEAFDIAELRSSTIMRERKTRKTTSAEIRSLYRQSLQVGPDSAIFRKFILEKLEEANTDPCAPPFDSLQTYAFEGTGSLAGSLSSLESAVSDQDESYDYLNELGPRFKRLACMFGSAVQSNN

SEQ ID NO: 1457 - protein, 780 aa, artificial
  rhCDH19(1-43)::FLAG::rhCDH19(44-772)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTASDADDPSSGNNARLLYSLLQGQPYFSVEPTTGVIRISSKMDRELQDEYWVIIQAKDMIGQPGALSGTTSVLIKLSDVNDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 1458 - protein, 723 aa, artificial
  caCDH19(1-42)::FLAG::caCDH19(43-770)
QFFVPEEMNKTDYHIGQLRSDLDNGNNSFQYKLLGAGAGSIFVIDERTGDIYAIQKLDREERSLYTLRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 1459 - protein, 779 aa, artificial
  rhCDH19(1-43):FLAG::rhCDH19(44-141)::caCDH19(141-770)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 1460 - protein, 779 aa, artificial
  rhCDH19(1-43)::FLAG::rhCDH19(44-65)::caCDH19(65-770)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSIFVIDERTGDIYAIQKLDREERSLYTLRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 1461 - protein, 778 aa, artificial
  caCDH19(1-43)::FLAG::caCDH19(44-87)::rhCDH19(89-114)::caCDH19(115 -770)
MNYCFLLPLMLGIPLIWPCFTASESSKTEVKHQAGSHLRVKRDYKDDDDKGWMWNQFFVPEEMNKTDYHIGQLRSDLDNGNNSFQYKLLGAGAGSTFIIDERTGDIYAIEKLDREERSLYILRAQVIDSTTGRAVEPESEFVIRVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 1462 - protein, 778 aa, artificial
  caCDH19(1-43)::FLAG::caCDH19(44-120)::rhCDH19(122-137)::caCDH19(1 37-770)
MNYCFLLPLMLGIPLIWPCFTASESSKTEVKHQAGSHLRVKRDYKDDDDKGWMWNQFFVPEEMNKTDYHIGQLRSDLDNGNNSFQYKLLGAGAGSIFVIDERTGDIYAIQKLDREERSLYTLRAQVIDITTGRAVEPESEFVIKVSDINDNEPKFLDEPYEAIVPEMSPEGTLVIQVTATDADDPASGNNARLLYSLLQGQPYFSIEPTTGVIRISSKMDRELQDEYWVIIQAKDMIGLPGALSGTTSVLIKLSDVNDNKPIFKERLYRLTVSESAPTGTSIGRIMAYDNDIGENAEMDYSIEDDSQTFDIITNNETQEGIVILKKKVDFEHQNHYLIRANVKNRHVAEHLMEYHVEASTTFVRVQVEDEDEPPVFLLPYYLFEILEESPHGSFVGMVSATDPDQRKSPIRYSITRSKVFSIDDNGTIITTNPLDREISAWYNLSITATEKYNVQQISAVPVYVQVLNINDHAPEFSEYYDSYVCENAGSGQVIQTISAVDRDESVEDHHFYFNLSVEDTKNSSFIIIDNEDNTAVILTNRTGFSLQEEPVFYISVLIADNGIPSLTSTNTLTIHICDCDDYGSTQTCRDKDLLLSMGFRTEVILAILISIMIIFGFIFLILGLKQRRKPTLFPEKGEDFRENIFRYDDEGGGEEDTEAFDIVQLRSSTIMRERKTRKTAAAEIRSLYRQSLQVGPDSAIFRKFILEKLEEANTDPCAPPFDSLQTYAFEGTGSLAGSLSSLGSAVSDQDENYDYLNELGPRFKRLACMFGSAMQSNN

SEQ ID NO: 1463 - protein, 780 aa, artificial
  rhCDH19(1-43)::FLAG::rhCDH19(44-141)::raCDH19(140-247)::rhCDH19(2 50-772)
MNCYLLLPFMLGIPLLWPCLGATENSQTKKVQQPVGSHLRVKRDYKDDDDKGWVWNQFFVPEEMNTTSHHVGRLRSDLDNGNNSFQYKLLGAGAGSTFIIDERTGDIYAIEKLDREERSLYILRAQVIDITTGRAVEPESEFVIKVSDINDNEPRFLDEPYEAIVPEMSPEGTFVIKVTANDADDPTSGYHARILYNLEQGQPYFSVEPTTGVIRISSKMDRELQDTYCVIIQAKDMLGQPGALSGTTTISIKLSDINDNKPIFKESLYRLTVSESAPTGTSIGTIMAYDNDIGENAEMDYSIEEDDSQTFDIITNHETQEGIVILKKKVNFEHQNHYGIRAKVKNHHVDEQLMKYHTEASTTFIKIQVEDVDEPPLFLLPYYIFEIFEETPQGSFVGVVSATDPDNRKSPIRYSITRSKVFNIDDNGTITTTNSLDREISAWYNLSITATEKYNIEQISSIPVYVQVLNINDHAPEFSQYYESYVCENAGSGQVIQTISAVDRDESIEEHHFYFNLSVEDTNSSSFTIIDNQDNTAVILTNRTGFNLQEEPIFYISILIADNGIPSLTSTNTLTIHVCDCDDSGSTQTCQYQELMLSMGFKTEVIIAILICIMVIFGFIFLTLGLKQRRKQILFPEKSEDFRENIFRYDDEGGGEEDTEAFDVAALRSSTIMRERKTRKTTSAEIRSLYRQSLQVGPDSAIFRKFILEKLEEADTDPCAPPFDSLQTYAFEGTGSLAGSLSSLESAVSDQDESYDYLNELGPRFKRLACMFGSAVQSNN

SEQ ID NO: 1464 - protein, 778 aa, artificial
  raCDH19(1-43)::FLAG::raCDH19(44-770)
MNHYFLKYWILMVPLIWPCLKVAETLKIEKAQRAVPSLGRAKRDYKDDDDKGWVWKQFVVPEEMDTIQHVGRLRSDLDNGNNSFQYKLLGTGDGSFSIDEKTGDIFAMQKLDREKQSLYILRAQVIDTTIGKAVEPESEFVIRVSDVNDNEPRFLDEPYEAIVPEMSPEGTFVIKVTANDADDPTSGYHARILYNLEQGQPYFSVEPTTGVIRISSKMDRELQDTYCVIIQAKDMLGQPGALSGTTTISIKLSDINDNKPIFKESFYRFTISESAPSGTTIGKIMAYDDDIGENAEMDYSIEDDESQIFDIVIDNETQEGIVILKKKVDFEHQNHYGIRVKVKNCHVDEELAPAHVNASTTYIKVQVEDEDEPPTFLLPYYIFEIPEGKPYGTMVGTVSAVDPDRRQSPMRYSLIGSKMFDINGNGTIVTTNLLDREVSAWYNLSVTATETYNVQQISSAHVYVQVLNINDHAPEFSQLYETYVCENAESGEIIQTISAIDRDESIEDHHFYFNHSVEDTNNSSFILTDNQDNTAVILSNRAGFSLKEETVFYMIILIADNGIPPLTSTNTLTIQVCDCGDSRSTETCTSKELLFIMGFKAEAIIAIVICVMVIFGFIFLILALKQRRKETLFPEKTEDFRENIFCYDDEGGGEEDSEAFDIIELRQSTVMRERKPRKSRSAEIRSLYRQSLQVGPDSAIFRKFILEKLEEANTDSSAPPFDSLQTFAYEGTGSSAGSLSSLGSSVTDQEDDFDYLNDLGPCFKRLANMFGSAVQPDN

SEQ ID NO: 1465 - protein, 778 aa, artificial
  (1-43)::FLAG::muCDH19(44-323)::raCDH19(324-327)::muCDH19(328-770)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEHQNHYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 1466 - protein, 778 aa, artificial
  muCDH19(1-43)::FLAG::muCDH19(44-770)::raCDH19(290,299,308)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPIGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 1467 - protein, 778 aa, artificial
  muCDH19(1-43)::FLAG::muCDH19(44-770)::huCDH19(271)
MNYCFLKHWILMIPLLWPCLKVSETLKAEKARRTVPSTWRAKRDYKDDDDKAWVWRPFVVLEEMDDIQCVGKLRSDLDNGNNSFQYKLLGIGAGSFSINERTGEICAIQKLDREEKSLYILRAQVIDTTIGKAVETESEFVIRVLDINDNEPRFLDEPYEAIVPEMSPEGTFVIKVTANDADDPSTGYHARILYNLERGQPYFSVEPTTGVIRISSKMDRELQDTYCVIIQAKDMLGQPGALSGTTTVSIKLSDINDNKPIFKESFYRFTISESAPTGTSIGKIMAYDDDIGENAEMEYSIEDDDSKIFDIIIDNDTQEGIVILKKKVDFEQQSYYGIRAKVKNCHVDEELAPAHVNASTTYIKVQVEDEDEPPVFLLPYYILEIPEGKPYGTIVGTVSATDPDRRQSPMRYYLTGSKMFDINDNGTIITTNMLDREVSAWYNLTVTATETYNVQQISSAHVYVQVFNINDNAPEFSQFYETYVCENAESGEIVQIISAIDRDESIEDHHFYFNHSLEDTNNSSFMLTDNQDNTAVILSNRTGFNLKEEPVFYMIILIADNGIPSLTSTNTLTIQVCDCGDSRNTETCANKGLLFIMGFRTEAIIAIMICVMVIFGFFFLILALKQRRKETLFPEKTEDFRENIFCYDDEGGGEEDSEAFDIVELRQSTVMRERKPQRSKSAEIRSLYRQSLQVGPDSAIFRKFILEKLEEANTDPCAPPFDSLQTFAYEGTGSSAGSLSSLASRDTDQEDDFDYLNDLGPRFKRLASMFGSAVQPNN

SEQ ID NO: 1468 - DNA, 375 bp, artificial
  VH of CDH19 14302 CC x I2C
caggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1469 - protein, 125 aa, artificial
  VH of CDH19 14302 CC x I2C
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSS

SEQ ID NO: 1470 - DNA, 318 bp, artificial
  VL of CDH19 14302 CC x I2C
tcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1471 - protein, 106 aa, artificial
  VL of CDH19 14302 CC x I2C
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1472 - DNA, 738 bp, artificial
  VH-VL of CDH19 14302 CC x I2C
caggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1473 - protein, 246 aa, artificial
  VH-VL of CDH19 14302 CC x I2C
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1474 - protein, 507 aa, artificial
  CDH19 14302 CC x I2C
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1475 - protein, 501 aa, artificial
  CDH19 14302 x F12q0
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1476 - protein, 501 aa, artificial
  CDH19 14302 CC x F12q0
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1477 - DNA, 429 bp, artificial
  VH of CDH19 21-14302 x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1478 - protein, 143 aa, artificial
  VH of CDH19 21-14302 x I2C
RLIEDICLPRWGCLWEDDQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 1479 - DNA, 318 bp, artificial; identical to SEQ ID NO: 1186
  VL of CDH19 21-14302 x I2C

SEQ ID NO: 1480 - protein, 106 aa, artificial; identical to SEQ ID NO: 1187
  VL of CDH19 21-14302 x I2C

SEQ ID NO: 1481 - DNA, 792 bp, artificial
  VH-VL of CDH19 21-14302 x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1482 - protein, 264 aa, artificial
  VH-VL of CDH19 21-14302 x I2C
RLIEDICLPRWGCLWEDDQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1483 - protein, 525 aa, artificial
  CDH19 21-14302 x I2C
RLIEDICLPRWGCLWEDDQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1484 - DNA, 429 bp, artificial
  VH of CDH19 21-14302 CC x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1485 - protein, 143 aa, artificial
  VH of CDH19 21-14302 CC x I2C
RLIEDICLPRWGCLWEDDQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSS

SEQ ID NO: 1486 - DNA, 318 bp, artificial; identical to SEQ ID NO: 1470
  VL of CDH19 21-14302 CC x I2C

SEQ ID NO: 1487 - protein, 106 aa, artificial; identical to SEQ ID NO: 1471
  VL of CDH19 21-14302 CC x I2C

SEQ ID NO: 1488 - DNA, 792 bp, artificial
  VH-VL of CDH19 21-14302 CC x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1489 - protein, 264 aa, artificial
  VH-VL of CDH19 21-14302 CC x I2C
RLIEDICLPRWGCLWEDDQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1490 - protein, 525 aa, artificial
  CDH19 21-14302 CC x I2C
RLIEDICLPRWGCLWEDDQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1491 - protein, 525 aa, artificial
  CDH19 14302 x I2C-21
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1492 - protein, 525 aa, artificial
  CDH19 14302 CC x I2C-21
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1493 - DNA, 438 bp, artificial
  VH of CDH19 14302 x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1494 - protein, 146 aa, artificial
  VH of CDH19 14302 x I2C x FcBY
QRFCTGHFGGLYPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSS

SEQ ID NO: 1495 - DNA, 318 bp, artificial; identical to SEQ ID NO: 1186
  VL of CDH19 14302 x I2C x FcBY

SEQ ID NO: 1496 - protein, 106 aa, artificial; identical to SEQ ID NO: 1187
  VL of CDH19 14302 x I2C x FcBY

SEQ ID NO: 1497 - DNA, 801 bp, artificial
  VH-VL of CDH19 14302 x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1498 - protein, 267 aa, artificial
  VH-VL of CDH19 14302 x I2C x FcBY
QRFCTGHFGGLYPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1499 - protein, 549 aa, artificial
  CDH19 14302 x I2C x FcBY
QRFCTGHFGGLYPCNGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1500 - DNA, 438 bp, artificial
  VH of CDH19 14302 CC x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1501 - protein, 146 aa, artificial
  VH of CDH19 14302 CC x I2C x FcBY
QRFCTGHFGGLYPCNGGGGGSQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSS

SEQ ID NO: 1502 - DNA, 318 bp, artificial; identical to SEQ ID NO: 1470
  VL of CDH19 14302 CC x I2C x FcBY

SEQ ID NO: 1503 - protein, 106 aa, artificial; identical to SEQ ID NO: 1471
  VL of CDH19 14302 CC x I2C x FcBY

SEQ ID NO: 1504 - DNA, 801 bp, artificial
  VH-VL of CDH19 14302 CC x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgatggaagtaataaatactatgcagactccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1505 - protein, 267 aa, artificial
  VH-VL of CDH19 14302 CC x I2C x FcBY
QRFCTGHFGGLYPCNGGGGGSQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1506 - protein, 549 aa, artificial
  CDH19 14302 CC x I2C x FcBY
QRFCTGHFGGLYPCNGGGGGSQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1507 - DNA, 375 bp, artificial
  VH of CDH19 14303 CC x I2C
caggtgcagttggtggagtctgggggaggcgtggtccagcctgggaggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1508 - protein, 125 aa, artificial
  VH of CDH19 14303 CC x I2C
QVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSS

SEQ ID NO: 1509 - DNA, 318 bp, artificial; identical to SEQ ID NO: 1470
  VL of CDH19 14303 CC x I2C

SEQ ID NO: 1510 - protein, 106 aa, artificial; identical to SEQ ID NO: 1471
  VL of CDH19 14303 CC x I2C

SEQ ID NO: 1511 - DNA, 738 bp, artificial
  VH-VL of CDH19 14303 CC x I2C
caggtgcagttggtggagtctgggggaggcgtggtccagcctgggaggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1512 - protein, 246 aa, artificial
  VH-VL of CDH19 14303 CC x I2C
QVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1513 - protein, 507 aa, artificial
  CDH19 14303 CC x I2C
QVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1514 - protein, 501 aa, artificial
  CDH19 14303 x F12q0
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1515 - protein, 501 aa, artificial
  CDH19 14303 CC x F12q0
QVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1516 - protein, 525 aa, artificial
  CDH19 14303 x I2C-21
QVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1517 - protein, 525 aa, artificial
  CDH19 14303 CC x I2C-21
QVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1518 - DNA, 438 bp, artificial
  VH of CDH19 14303 x I2C x FcBY
caacgtttctgtaccggtcacttcggtggtctgtacccgtgtaatggtggtggtggtggttcgcaggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1519 - protein, 146 aa, artificial
  VH of CDH19 14303 x I2C x FcBY
QRFCTGHFGGLYPCNGGGGGSQVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSS

SEQ ID NO: 1520 - DNA, 318 bp, artificial; identical to SEQ ID NO: 1186
  VL of CDH19 14303 x I2C x FcBY

SEQ ID NO: 1521 - protein, 106 aa, artificial; identical to SEQ ID NO: 1187
  VL of CDH19 14303 x I2C x FcBY

SEQ ID NO: 1522 - DNA, 801 bp, artificial
  VH-VL of CDH19 14303 x I2C x FcBY
caacgtttctgtaccggtcacttcggtggtctgtacccgtgtaatggtggtggtggtggttcgcaggtgcagttggtggagtctgggggaggcgtggtccagcctgggaggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1523 - protein, 267 aa, artificial
  VH-VL of CDH19 14303 x I2C x FcBY
QRFCTGHFGGLYPCNGGGGGSQVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1524 - protein, 549 aa, artificial
  CDH19 14303 x I2C x FcBY
QRFCTGHFGGLYPCNGGGGGSQVQLVESGGGVVQPGRSLRLSCAASGFTFSSYGMHWVRQAPGKGLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1525 - DNA, 438 bp, artificial
  VH of CDH19 14303 CC x I2C x FcBY
caacgtttctgtaccggtcacttcggtggtctgtacccgtgtaatggtggtggtggtggttcgcaggtgcagttggtggagtctgggggaggcgtggtccagcctgggaggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagt

SEQ ID NO: 1526 - protein, 146 aa, artificial
  VH of CDH19 14303 CC x I2C x FcBY
QRFCTGHFGGLYPCNGGGGGSQVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSS

SEQ ID NO: 1527 - DNA, 318 bp, artificial; identical to SEQ ID NO: 1470
  VL of CDH19 14303 CC x I2C x FcBY

SEQ ID NO: 1528 - protein, 106 aa, artificial; identical to SEQ ID NO: 1471
  VL of CDH19 14303 CC x I2C x FcBY

SEQ ID NO: 1529 - DNA, 801 bp, artificial
  VH-VL of CDH19 14303 CC x I2C x FcBY
caacgtttctgtaccggtcacttcggtggtctgtacccgtgtaatggtggtggtggtggttcgcaggtgcagttggtggagtctgggggaggcgtggtccagcctgggaggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaaaagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1530 - protein, 267 aa, artificial
  VH-VL of CDH19 14303 CC x I2C x FcBY
QRFCTGHFGGLYPCNGGGGGSQVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1531 - protein, 549 aa, artificial
  CDH19 14303 CC x I2C x FcBY
QRFCTGHFGGLYPCNGGGGGSQVQLVESGGGVVQPGRSLRLSCAASGFTFSSYGMHWVRQAPGKCLEWVAFIWYEGSNKYYAESVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1532 - DNA, 375 bp, artificial
  VH of CDH19 14039 CC x I2C
caggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1533 - protein, 125 aa, artificial
  VH of CDH19 14039 CC x I2C
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSS

SEQ ID NO: 1534 - DNA, 318 bp, artificial; identical to SEQ ID NO: 1470
  VL of CDH19 14039 CC x I2C

SEQ ID NO: 1535 - protein, 106 aa, artificial; identical to SEQ ID NO: 1471
  VL of CDH19 14039 CC x I2C

SEQ ID NO: 1536 - DNA, 738 bp, artificial
  VH-VL of CDH19 14039 CC x I2C
caggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1537 - protein, 246 aa, artificial
  VH-VL of CDH19 14039 CC x I2C
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1538 - protein, 507 aa, artificial
  CDH19 14039 CC x I2C
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1539 - protein, 501 aa, artificial
  CDH19 14039 x F12q0
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1540 - protein, 501 aa, artificial
  CDH19 14039 CC x F12q0
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLRLSCAASGFTFNSYAMNWVRQAPGKGLEWVARIRSKYNNYATYYADSVKGRFTISRDDSKNTAYLQMNSLKTEDTAVYYCVRHGNFGNSYVSWWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1541 - DNA, 429 bp, artificial
  VH of CDH19 21-14039 x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1542 - protein, 143 aa, artificial
  VH of CDH19 21-14039 x I2C
RLIEDICLPRWGCLWEDDQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 1543 - DNA, 318 bp, artificial; identical to SEQ ID NO: 1186
  VL of CDH19 21-14039 x I2C

SEQ ID NO: 1544 - protein, 106 aa, artificial; identical to SEQ ID NO: 1187
  VL of CDH19 21-14039 x I2C

SEQ ID NO: 1545 - DNA, 792 bp, artificial
  VH-VL of CDH19 21-14039 x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1546 - protein, 264 aa, artificial
  VH-VL of CDH19 21-14039 x I2C
RLIEDICLPRWGCLWEDDQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1547 - protein, 525 aa, artificial
  CDH19 21-14039 x I2C
RLIEDICLPRWGCLWEDDQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1548 - DNA, 429 bp, artificial
  VH of CDH19 21-14039 CC x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1549 - protein, 143 aa, artificial
  VH of CDH19 21-14039 CC x I2C
RLIEDICLPRWGCLWEDDQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSS

SEQ ID NO: 1550 - DNA, 318 bp, artificial; identical to SEQ ID NO: 1470
  VL of CDH19 21-14039 CC x I2C

SEQ ID NO: 1551 - protein, 106 aa, artificial; identical to SEQ ID NO: 1471
  VL of CDH19 21-14039 CC x I2C

SEQ ID NO: 1552 - DNA, 792 bp, artificial
  VH-VL of CDH19 21-14039 CC x I2C
cggctgatcgaggacatctgcctgcccagatggggctgcctgtgggaggacgaccaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1553 - protein, 264 aa, artificial
  VH-VL of CDH19 21-14039 CC x I2C
RLIEDICLPRWGCLWEDDQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1554 - protein, 525 aa, artificial
  CDH19 21-14039 CC x I2C
RLIEDICLPRWGCLWEDDQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1555 - protein, 525 aa, artificial
  CDH19 14039 x I2C-21
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1556 - protein, 525 aa, artificial
  CDH19 14039 CC x I2C-21
QVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLRLIEDICLPRWGCLWEDDHHHHHH

SEQ ID NO: 1557 - DNA, 438 bp, artificial
  VH of CDH19 14039 x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1558 - protein, 146 aa, artificial
  VH of CDH19 14039 x I2C x FcBY
QRFCTGHFGGLYPCNGGGGGSQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSS

SEQ ID NO: 1559 - DNA, 318 bp, artificial; identical to SEQ ID NO: 1186
  VL of CDH19 14039 x I2C x FcBY

SEQ ID NO: 1560 - protein, 106 aa, artificial; identical to SEQ ID NO: 1187
  VL of CDH19 14039 x I2C x FcBY

SEQ ID NO: 1561 - DNA, 801 bp, artificial
  VH-VL of CDH19 14039 x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaaggggctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggtggcggaggatctggcggaggtggaagcggaggcggcggatcttcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggcggagggaccaagctgaccgtccta

SEQ ID NO: 1562 - protein, 267 aa, artificial
  VH-VL of CDH19 14039 x I2C x FcBY
QRFCTGHFGGLYPCNGGGGGSQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVL

SEQ ID NO: 1563 - protein, 549 aa, artificial
  CDH19 14039 x I2C x FcBY
QRFCTGHFGGLYPCNGGGGGSQVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1564 - DNA, 438 bp, artificial
  VH of CDH19 14039 CC x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagt

SEQ ID NO: 1565 - protein, 146 aa, artificial
  VH of CDH19 14039 CC x I2C x FcBY
QRFCTGHFGGLYPCNGGGGGSQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSS

SEQ ID NO: 1566 - DNA, 318 bp, artificial; identical to SEQ ID NO: 1470
  VL of CDH19 14039 CC x I2C x FcBY

SEQ ID NO: 1567 - protein, 106 aa, artificial; identical to SEQ ID NO: 1471
  VL of CDH19 14039 CC x I2C x FcBY

SEQ ID NO: 1568 - DNA, 801 bp, artificial
  VH-VL of CDH19 14039 CC x I2C x FcBY
caacgtttctgtaccggtcacttcggtggtctgtacccgtgtaatggtggtggtggtggttcgcaggtgcagttggtggagtctgggggaggcgtggtccagcctggggggtccctgagactctcctgtgcagcgtctggattcaccttcagtagctatggcatgcactgggtccgccaggctccaggcaagtgtctggagtgggtggcatttatatggtatgagggaagtaataaatactatgcagagtccgtgaaggaccgattcaccatctccagagacaattccaagaacacgctgtatctgcaaatgaatagcctgagagctgaggacacggctgtgtattactgtgcgagaagggccggtataataggaactataggctactactacggtatggacgtctggggccaagggaccacggtcaccgtctctagtggaggcggaggatctggtggcggtggttctggcggcggaggctcctcctatgaactgactcagccaccctcagtgtccgtgtccccaggacagacagccagcatcacctgctctggagataggttgggggaaaaatatactagctggtatcagcagaggccaggccagtcccctttgctggtcatctatcaagataccaagcggccctcagggatccctgagcgattctctggctccaactctggtaacacagccactctgaccatcagcgggacccaggctatggatgaggctgactattactgtcaggcgtgggagagcagcactgtggtattcggctgcgggaccaagctgaccgtccta

SEQ ID NO: 1569 - protein, 267 aa, artificial
  VH-VL of CDH19 14039 CC x I2C x FcBY
QRFCTGHFGGLYPCNGGGGGSQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVL

SEQ ID NO: 1570 - protein, 549 aa, artificial
  CDH19 14039 CC x I2C  x FcBY
QRFCTGHFGGLYPCNGGGGGSQVQLVESGGGVVQPGGSLRLSCAASGFTFSSYGMHWVRQAPGKCLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1571 - protein, 532 aa, artificial
  CDH19 14302 x I2C-156
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSGGGSRDWDFDVFGGGTPVGGHHHHHH

SEQ ID NO: 1572 - protein, 549 aa, artificial
  CDH19 14302 x I2C-LFcBY
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 1573 - protein, 527 aa, artificial
  CDH19 14302 x I2C-LFcBY-156
QRFVTGHFGGLYPANGGGGGSQVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGS

SEQ ID NO: 1574 - protein, 514 aa, artificial
  CDH19 14302 x I2C-Cys-Loop
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 1575 - protein, 1100 aa, artificial [sequence omitted]

SEQ ID NO: 1576 - protein, 717 aa, artificial
  CDH19 14302 x I2C-GS-D3HSA
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1577 - protein, 727 aa, artificial
  CDH19 14302 x I2C-3GS-D3HSA
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 1578 - protein, 742 aa, artificial
  CDH19 14302 x I2C-GS-D3HSA-156
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRDWDFDVFGGGTPVGGHHHHHH

SEQ ID NO: 1579 - protein, 752 aa, artificial
  CDH19 14302 x I2C-3GS-D3HSA-156
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRDWDFDVFGGGTPVGGHHHHHH

SEQ ID NO: 1580 - protein, 744 aa, artificial
  CDH19 14302 x I2C-GS-D3HSA-21
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRLIEDICLPRWGCLWEDDHHHHHH

SEQ ID NO: 1581 - protein, 754 aa, artificial
  CDH19 14302 x I2C-3GS-D3HSA-21
QVQLVESGGGVVQPGGSLRLSCAASGFTFSSYGMHWVRQAPGKGLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRLIEDICLPRWGCLWEDDHHHHHH

SEQ ID NO: 1582 - protein, 5 aa, artificial
  CDR-H1 of CDH19 65231.002
SYYWS

SEQ ID NO: 1583 - protein, 16 aa, artificial
  CDR-H2 of CDH19 65231.002
YIYYSGSTNYNPSLKS

SEQ ID NO: 1584 - protein, 17 aa, artificial
  CDR-H3 of CDH19 65231.002
DQRRIAAAGTHFYGMDV

SEQ ID NO: 1585 - protein, 12 aa, artificial
  CDR-L1 of CDH19 65231.002
RASQSVSSSYLA

SEQ ID NO: 1586 - protein, 7 aa, artificial
  CDR-L2 of CDH19 65231.002
GTSSRAT

SEQ ID NO: 1587 - protein, 9 aa, artificial
  QQYGSSPFT
QQYGSSPFT

SEQ ID NO: 1588 - DNA, 375 bp, artificial
  VH of CDH19 65231.002
caggtgcagctgcaggaatccggccctggcctggccaagccctccgagacactgtccctgacctgcaccgtgtccggcgactccatcacctcctactactggtcctggatccggcagccccctggcaagggcctggaatggatcggctacatctactactccggctccaccaactacaaccccagcctgaagtccagagtgaccatctccgtggacacctccaagaaccagttctccctgaagctgtcctccgtgaccgccgctgacaccgccgtgtactactgcgccagggaccagcggagaatcgccgctgccggcacccacttctacggcatggatgtgtggggccagggcaccctcgtgaccgtgtctagc

SEQ ID NO: 1589 - protein, 125 aa, artificial; identical to SEQ ID NO: 507
  VH of CDH19 65231.002

SEQ ID NO: 1590 - DNA, 327 bp, artificial
  VL of CDH19 65231.002
gagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcacctcctccagagccaccggcatccctgaccggttctccggctctggctccggcaccgacttcaccctgaccatcagccggctggaacccgaggacttcgctgtgtactattgccagcagtacggctccagccccttcaccttcggcggaggcaccaaggtggaaatcaagtcc

SEQ ID NO: 1591 - protein, 109 aa, artificial
  VL of CDH19 65231.002
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKS

SEQ ID NO: 1592 - DNA, 747 bp, artificial
  VH-VL of CDH19 65231.002
caggtgcagctgcaggaatccggccctggcctggccaagccctccgagacactgtccctgacctgcaccgtgtccggcgactccatcacctcctactactggtcctggatccggcagccccctggcaagggcctggaatggatcggctacatctactactccggctccaccaactacaaccccagcctgaagtccagagtgaccatctccgtggacacctccaagaaccagttctccctgaagctgtcctccgtgaccgccgctgacaccgccgtgtactactgcgccagggaccagcggagaatcgccgctgccggcacccacttctacggcatggatgtgtggggccagggcaccctcgtgaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcacctcctccagagccaccggcatccctgaccggttctccggctctggctccggcaccgacttcaccctgaccatcagccggctggaacccgaggacttcgctgtgtactattgccagcagtacggctccagccccttcaccttcggcggaggcaccaaggtggaaatcaagtcc

SEQ ID NO: 1593 - protein, 249 aa, artificial
  VH-VL of CDH19 65231.002
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSGGGGSGGGGSGGGGSEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKS

SEQ ID NO: 1594 - protein, 509 aa, artificial
  CDH19 65231.002 x I2C
QVQLQESGPGLAKPSETLSLTCTVSGDSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSGGGGSGGGGSGGGGSEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1595 - protein, 5 aa, artificial
  CDR-H1 of CDH19 65231.003
SYYWS

SEQ ID NO: 1596 - protein, 16 aa, artificial
  CDR-H2 of CDH19 65231.003
YIYYSGSTNYNPSLKS

SEQ ID NO: 1597 - protein, 17 aa, artificial
  CDR-H3 of CDH19 65231.003
DQRRIAAAGTHFYGMDV

SEQ ID NO: 1598 - protein, 12 aa, artificial
  CDR-L1 of CDH19 65231.003
RASQSVSSSYLA

SEQ ID NO: 1599 - protein, 7 aa, artificial
  CDR-L2 of CDH19 65231.003
GTSSRAT

SEQ ID NO: 1600 - protein, 9 aa, artificial
  CDR-L3 of CDH19 65231.003
QQYGSSPFT

SEQ ID NO: 1601 - DNA, 375 bp, artificial
  VH of CDH19 65231.003
caggtgcagctgcaggaatccggccctggcctggccaagccctccgagacactgtccctgacctgcaccgtgtccggcggctccatcacctcctactactggtcctggatccggcagccccctggcaagggcctggaatggatcggctacatctactactccggctccaccaactacaaccccagcctgaagtccagagtgaccatctccgtggacacctccaagaaccagttctccctgaagctgtcctccgtgaccgccgctgacaccgccgtgtactactgcgccagggaccagcggagaatcgccgctgccggcacccacttctacggcatggatgtgtggggccagggcaccctcgtgaccgtgtctagc

SEQ ID NO: 1602 - protein, 125 aa, artificial
  VH of CDH19 65231.003
QVQLQESGPGLAKPSETLSLTCTVSGGSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSS

SEQ ID NO: 1603 - DNA, 327 bp, artificial
  VL of CDH19 65231.003
gagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcacctcctccagagccaccggcatccctgaccggttctccggctctggctccggcaccgacttcaccctgaccatcagccggctggaacccgaggacttcgctgtgtactattgccagcagtacggctccagccccttcaccttcggccaaggcaccaaggtggaaatcaagtcc

SEQ ID NO: 1604 - protein, 109 aa, artificial
  VL of CDH19 65231.003
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKS

SEQ ID NO: 1605 - DNA, 747 bp, artificial
  VH-VL of CDH19 65231.003
caggtgcagctgcaggaatccggccctggcctggccaagccctccgagacactgtccctgacctgcaccgtgtccggcggctccatcacctcctactactggtcctggatccggcagccccctggcaagggcctggaatggatcggctacatctactactccggctccaccaactacaaccccagcctgaagtccagagtgaccatctccgtggacacctccaagaaccagttctccctgaagctgtcctccgtgaccgccgctgacaccgccgtgtactactgcgccagggaccagcggagaatcgccgctgccggcacccacttctacggcatggatgtgtggggccagggcaccctcgtgaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcacctcctccagagccaccggcatccctgaccggttctccggctctggctccggcaccgacttcaccctgaccatcagccggctggaacccgaggacttcgctgtgtactattgccagcagtacggctccagccccttcaccttcggccaaggcaccaaggtggaaatcaagtcc

SEQ ID NO: 1606 - protein, 249 aa, artificial
  VH-VL of CDH19 65231.003
QVQLQESGPGLAKPSETLSLTCTVSGGSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSGGGGSGGGGSGGGGSEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKS

SEQ ID NO: 1607 - protein, 509 aa, artificial
  CDH19 65231.003 x I2C
QVQLQESGPGLAKPSETLSLTCTVSGGSITSYYWSWIRQPPGKGLEWIGYIYYSGSTNYNPSLKSRVTISVDTSKNQFSLKLSSVTAADTAVYYCARDQRRIAAAGTHFYGMDVWGQGTLVTVSSGGGGSGGGGSGGGGSEIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPFTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1608 - protein, 5 aa, artificial
  CDR-H1 of CDH19 65234.001
SYYWS

SEQ ID NO: 1609 - protein, 16 aa, artificial
  CDR-H2 of CDH19 65234.001
YIYYIGSTNYNPSLKS

SEQ ID NO: 1610 - protein, 14 aa, artificial
  CDR-H3 of CDH19 65234.001
DSRYRSGWYDAFDI

SEQ ID NO: 1611 - protein, 12 aa, artificial
  CDR-L1 of CDH19 65234.001
RASQSVAGSYLA

SEQ ID NO: 1612 - protein, 7 aa, artificial
  CDR-L2 of CDH19 65234.001
GASSRAT

SEQ ID NO: 1613 - protein, 9 aa, artificial
  CDR-L3 of CDH19 65234.001
QQYGKSPIT

SEQ ID NO: 1614 - DNA, 366 bp, artificial; identical to SEQ ID NO: 1002
  VH of CDH19 65234.001

SEQ ID NO: 1615 - protein, 122 aa, artificial; identical to SEQ ID NO: 338
  VH of CDH19 65234.001

SEQ ID NO: 1616 - DNA, 327 bp, artificial
  VL of CDH19 65234.001
gatatcgtgctgacccagtcccccggcaccctgtctctgagccctggcgagagagccaccctgtcctgcagagcctctcagtccgtggccggctcctacctggcttggtatcagcagaagcccggccaggcccctcggctgctgatctacggcgcctcttctagagccaccggcatccctgaccggttctccggctctggctccggcaccgacttcaccctgaccatcagccggctggaacccgaggacttcgccgtgtactattgccagcagtacggcaagtcccccatcaccttcggccagggaacccggctggaaatgaagtcc

SEQ ID NO: 1617 - protein, 109 aa, artificial
  VL of CDH19 65234.001
DIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKS

SEQ ID NO: 1618 - DNA, 738 bp, artificial
  VH-VL of CDH19 65234.001
caggtgcagctgcaggaatccggccctggcctggtcaagccctccgagacactgtccctgacctgcaccgtgtccggcggctccatcaactcctactactggtcctggatccggcagccccctggcaagggcctggaatggatcggctacatctactacatcggctccaccaactacaaccccagcctgaagtccagagtgaccatctccgtggacacctccaagaaccagttctccctgaagctgtcctccgtgaccgccgctgacaccgccctgtactactgcgccagagactcccggtacagatccgggtggtacgacgccttcgacatctggggccagggcaccatggtcaccgtgtcctctggtggcggaggctctggcggaggtggaagcggaggcggcggatccgatatcgtgctgacccagtcccccggcaccctgtctctgagccctggcgagagagccaccctgtcctgcagagcctctcagtccgtggccggctcctacctggcttggtatcagcagaagcccggccaggcccctcggctgctgatctacggcgcctcttctagagccaccggcatccctgaccggttctccggctctggctccggcaccgacttcaccctgaccatcagccggctggaacccgaggacttcgccgtgtactattgccagcagtacggcaagtcccccatcaccttcggccagggaacccggctggaaatgaagtcc

SEQ ID NO: 1619 - protein, 246 aa, artificial
  VH-VL of CDH19 65234.001
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSGGGGSGGGGSGGGGSDIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKS

SEQ ID NO: 1620 - protein, 506 aa, artificial
  CDH19 65234.001 x I2C
QVQLQESGPGLVKPSETLSLTCTVSGGSINSYYWSWIRQPPGKGLEWIGYIYYIGSTNYNPSLKSRVTISVDTSKNQFSLKLSSVTAADTALYYCARDSRYRSGWYDAFDIWGQGTMVTVSSGGGGSGGGGSGGGGSDIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1621 - protein, 5 aa, artificial
  CDR-H1 of CDH19 65234.004
SYYWS

SEQ ID NO: 1622 - protein, 16 aa, artificial
  CDR-H2 of CDH19 65234.004
YIYYIGSTNYNPSLKS

SEQ ID NO: 1623 - protein, 14 aa, artificial
  CDR-H3 of CDH19 65234.004
ESRYRSGWYDAFDI

SEQ ID NO: 1624 - protein, 12 aa, artificial
  CDR-L1 of CDH19 65234.004
RASQSVAGSYLA

SEQ ID NO: 1625 - protein, 7 aa, artificial
  CDR-L2 of CDH19 65234.004
GASSRAT

SEQ ID NO: 1626 - protein, 9 aa, artificial
  CDR-L3 of CDH19 65234.004
QQYGKSPIT

SEQ ID NO: 1627 - DNA, 366 bp, artificial
  VH of CDH19 65234.004
caggtgcagctgcaggaatccggccctggcctggtcaagccctccgagacactgtccctgacctgcaccgtgtccggcggctccatcagctcctactactggtcctggatccggcagccccctggcaagggcctggaatggatcggctacatctactacatcggctccaccaactacaaccccagcctgaagtccagagtgaccatctccgtggacacctccaagaaccagttctccctgaagctgtcctccgtgaccgccgctgacaccgccctgtactactgcgccagagagtcccggtacagatccgggtggtacgacgccttcgacatctggggccagggcaccatggtcaccgtgtcctct

SEQ ID NO: 1628 - protein, 122 aa, artificial
  VH of CDH19 65234.004
QVQLQESGPGLVKPSETLSLTCTVSGGSISSYYWSWIRQPPGKGLEWIGYIYYIGSTNYNPSLKSRVTISVDTSKNQFSLKLSSVTAADTALYYCARESRYRSGWYDAFDIWGQGTMVTVSS

SEQ ID NO: 1629 - DNA, 327 bp, artificial; identical to SEQ ID NO: 1616
  VL of CDH19 65234.004

SEQ ID NO: 1630 - protein, 109 aa, artificial; identical to SEQ ID NO: 1617
  VL of CDH19 65234.004

SEQ ID NO: 1631 - DNA, 738 bp, artificial
  VH-VL of CDH19 65234.004
caggtgcagctgcaggaatccggccctggcctggtcaagccctccgagacactgtccctgacctgcaccgtgtccggcggctccatcagctcctactactggtcctggatccggcagccccctggcaagggcctggaatggatcggctacatctactacatcggctccaccaactacaaccccagcctgaagtccagagtgaccatctccgtggacacctccaagaaccagttctccctgaagctgtcctccgtgaccgccgctgacaccgccctgtactactgcgccagagagtcccggtacagatccgggtggtacgacgccttcgacatctggggccagggcaccatggtcaccgtgtcctctggtggcggaggctctggcggaggtggaagcggaggcggcggatccgatatcgtgctgacccagtcccccggcaccctgtctctgagccctggcgagagagccaccctgtcctgcagagcctctcagtccgtggccggctcctacctggcttggtatcagcagaagcccggccaggcccctcggctgctgatctacggcgcctcttctagagccaccggcatccctgaccggttctccggctctggctccggcaccgacttcaccctgaccatcagccggctggaacccgaggacttcgccgtgtactattgccagcagtacggcaagtcccccatcaccttcggccagggaacccggctggaaatgaagtcc

SEQ ID NO: 1632 - protein, 246 aa, artificial
  VH-VL of CDH19 65234.004
QVQLQESGPGLVKPSETLSLTCTVSGGSISSYYWSWIRQPPGKGLEWIGYIYYIGSTNYNPSLKSRVTISVDTSKNQFSLKLSSVTAADTALYYCARESRYRSGWYDAFDIWGQGTMVTVSSGGGGSGGGGSGGGGSDIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKS

SEQ ID NO: 1633 - protein, 506 aa, artificial
  CDH19 65234.004 x I2C
QVQLQESGPGLVKPSETLSLTCTVSGGSISSYYWSWIRQPPGKGLEWIGYIYYIGSTNYNPSLKSRVTISVDTSKNQFSLKLSSVTAADTALYYCARESRYRSGWYDAFDIWGQGTMVTVSSGGGGSGGGGSGGGGSDIVLTQSPGTLSLSPGERATLSCRASQSVAGSYLAWYQQKPGQAPRLLIYGASSRATGIPDRFSGSGSGTDFTLTISRLEPEDFAVYYCQQYGKSPITFGQGTRLEMKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1634 - protein, 5 aa, artificial
  CDR-H1 of CDH19 65235.005
SYFIH

SEQ ID NO: 1635 - protein, 17 aa, artificial
  CDR-H2 of CDH19 65235.005
IINPISVSTSYAQKFQG

SEQ ID NO: 1636 - protein, 11 aa, artificial
  CDR-H3 of CDH19 65235.005
GGIQLWLHLDY

SEQ ID NO: 1637 - protein, 13 aa, artificial
  CDR-L1 of CDH19 65235.005
SGSRSNIGSNFVN

SEQ ID NO: 1638 - protein, 7 aa, artificial
  CDR-L2 of CDH19 65235.005
TNNQRPS

SEQ ID NO: 1639 - protein, 11 aa, artificial
  CDR-L3 of CDH19 65235.005
ATYDESMQGWV

SEQ ID NO: 1640 - DNA, 360 bp, artificial
  VH of CDH19 65235.005
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacctggactattggggccagggcaccctggtcaccgtgtcctct

SEQ ID NO: 1641 - protein, 120 aa, artificial
  VH of CDH19 65235.005
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSS

SEQ ID NO: 1642 - DNA, 333 bp, artificial
  VL of CDH19 65235.005
cagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctacgacgagtccatgcagggctgggtgttcggcggaggcaccaagctgaccgtgctgtcc

SEQ ID NO: 1643 - protein, 111 aa, artificial
  VL of CDH19 65235.005
QSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLS

SEQ ID NO: 1644 - DNA, 738 bp, artificial
  VH-VL of CDH19 65234.005
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacctggactattggggccagggcaccctggtcaccgtgtcctctggtggcggaggctctggcggaggtggaagcggaggcggcggatcccagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctacgacgagtccatgcagggctgggtgttcggcggaggcaccaagctgaccgtgctgtcc

SEQ ID NO: 1645 - protein, 246 aa, artificial
  VH-VL of CDH19 65234.005
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLS

SEQ ID NO: 1646 - protein, 506 aa, artificial
  CDH19 65234.005 x I2C
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATYDESMQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1647 - protein, 5 aa, artificial
  CDR-H1 of CDH19 65235.002
SYFIH

SEQ ID NO: 1648 - protein, 17 aa, artificial
  CDR-H2 of CDH19 65235.002
IINPISVSTSYAQKFQG

SEQ ID NO: 1649 - protein, 11 aa, artificial
  CDR-H3 of CDH19 65235.002
GGIQLWLHLDY

SEQ ID NO: 1650 - protein, 13 aa, artificial
  CDR-L1 of CDH19 65235.002
SGSRSNIGSNFVN

SEQ ID NO: 1651 - protein, 7 aa, artificial
  CDR-L2 of CDH19 65235.002
TNNQRPS

SEQ ID NO: 1652 - protein, 11 aa, artificial
  CDR-L3 of CDH19 65235.002
ATWDDSMNGWV

SEQ ID NO: 1653 - DNA, 360 bp, artificial; identical to SEQ ID NO: 1015
  VH of CDH19 65235.002

SEQ ID NO: 1654 - protein, 120 aa, artificial; identical to SEQ ID NO: 368
  VH of CDH19 65235.002

SEQ ID NO: 1655 - DNA, 333 bp, artificial
  VL of CDH19 65235.002
cagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgactccatgaacggctgggtgttcggcggaggcaccaagctgaccgtgctgtcc

SEQ ID NO: 1656 - protein, 111 aa, artificial
  VL of CDH19 65235.002
QSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLS

SEQ ID NO: 1657 - DNA, 738 bp, artificial
  VH-VL of CDH19 65235.002
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctctggtggcggaggatctggcggaggtggaagcggaggcggcggatctcagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgactccatgaacggctgggtgttcggcggaggcaccaagctgaccgtgctgtcc

SEQ ID NO: 1658 - protein, 246 aa, artificial
  VH-VL of CDH19 65235.002
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDDSMNGWVFGGGTKLTVLS

SEQ ID NO: 1659 - protein, 506 aa, artificial; identical to SEQ ID NO: 1294
  CDH19 65235.002 x I2C

SEQ ID NO: 1660 - protein, 5 aa, artificial
  CDR-H1 of CDH19 65235.003
SYFIH

SEQ ID NO: 1661 - protein, 17 aa, artificial
  CDR-H2 of CDH19 65235.003
IINPISVSTSYAQKFQG

SEQ ID NO: 1662 - protein, 11 aa, artificial
  CDR-H3 of CDH19 65235.003
GGIQLWLHLDY

SEQ ID NO: 1663 - protein, 13 aa, artificial
  CDR-L1 of CDH19 65235.003
SGSRSNIGSNFVN

SEQ ID NO: 1664 - protein, 7 aa, artificial
  CDR-L2 of CDH19 65235.003
TNNQRPS

SEQ ID NO: 1665 - protein, 11 aa, artificial
  CDR-L3 of CDH19 65235.003
ATWDESMQGWV

SEQ ID NO: 1666 - DNA, 360 bp, artificial; identical to SEQ ID NO: 1015
  VH of CDH19 65235.003

SEQ ID NO: 1667 - protein, 120 aa, artificial; identical to SEQ ID NO: 368
  VH of CDH19 65235.003

SEQ ID NO: 1668 - DNA, 333 bp, artificial
  VL of CDH19 65235.003
cagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgagtccatgcagggctgggtgttcggcggaggcaccaagctgaccgtgctgtcc

SEQ ID NO: 1669 - protein, 111 aa, artificial
  VL of CDH19 65235.003
QSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLS

SEQ ID NO: 1670 - DNA, 738 bp, artificial
  VH-VL of CDH19 65235.003
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgttcatggaactgtcctccctgcggagcgaggacaccgccgtgtactactgcgccagaggcggcatccagctgtggctgcacctggactattggggccagggcaccctggtcaccgtgtcctctggtggcggaggatctggcggaggtggaagcggaggcggcggatctcagtctgccctgacccagcctccctccgtcaccggcacacctggccagcgcgtgaccatctcctgctccggctcccggtccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgagtccatgcagggctgggtgttcggcggaggcaccaagctgaccgtgctgtcc

SEQ ID NO: 1671 - protein, 246 aa, artificial
  VH-VL of CDH19 65235.003
QVQLVQSGAEVKKPGASVKVSCKVSGYTFTSYFIHWVRQAPGQGLEWMGIINPISVSTSYAQKFQGRVTMTRDTSTSTVFMELSSLRSEDTAVYYCARGGIQLWLHLDYWGQGTLVTVSSGGGGSGGGGSGGGGSQSALTQPPSVTGTPGQRVTISCSGSRSNIGSNFVNWYQQLPGTAPKVLIYTNNQRPSGVPDRFSGSKSGTSASLAISGLQSEDEADYYCATWDESMQGWVFGGGTKLTVLS

SEQ ID NO: 1672 - protein, 506 aa, artificial; identical to SEQ ID NO: 1307
  CDH19 65235.003 x I2C

SEQ ID NO: 1673 - protein, 5 aa, artificial
  CDR-H1 of CDH19 65236.001
SYAMN

SEQ ID NO: 1674 - protein, 17 aa, artificial
  CDR-H2 of CDH19 65236.001
TISGGGANTYYADSVKG

SEQ ID NO: 1675 - protein, 12 aa, artificial
  CDR-H3 of CDH19 65236.001
GGMGGYYYGMDV

SEQ ID NO: 1676 - protein, 11 aa, artificial
  CDR-L1 of CDH19 65236.001
RASQSISSNLA

SEQ ID NO: 1677 - protein, 7 aa, artificial
  CDR-L2 of CDH19 65236.001
GAFTRAT

SEQ ID NO: 1678 - protein, 9 aa, artificial
  CDR-L3 of CDH19 65236.001
QQYNYWPLT

SEQ ID NO: 1679 - DNA, 363 bp, artificial
  VH of CDH19 65236.001
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgccgacaccgccgtgtaccactgtgctaagggcggcatgggcggctactactacggcatggatgtgtggggccagggcaccaccgtgaccgtgtctagc

SEQ ID NO: 1680 - protein, 121 aa, artificial
  VH of CDH19 65236.001
QVQLLESGGGLVQPGGSLRLSCAASGFTFSSYAMNWVRQAPGKGLEWVSTISGGGANTYYADSVKGRFTISRDNSKSTLYLQMNSLRAADTAVYHCAKGGMGGYYYGMDVWGQGTTVTVSS

SEQ ID NO: 1681 - DNA, 324 bp, artificial
  VL of CDH19 65236.001
gagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaagtcc

SEQ ID NO: 1682 - protein, 108 aa, artificial
  VL of CDH19 65236.001
EIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKS

SEQ ID NO: 1683 - DNA, 732 bp, artificial
  VH-VL of CDH19 65236.001
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgccgacaccgccgtgtaccactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaagtcc

SEQ ID NO: 1684 - protein, 244 aa, artificial
  VH-VL of CDH19 65236.001
QVQLLESGGGLVQPGGSLRLSCAASGFTFSSYAMNWVRQAPGKGLEWVSTISGGGANTYYADSVKGRFTISRDNSKSTLYLQMNSLRAADTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKS

SEQ ID NO: 1685 - protein, 504 aa, artificial
  CDH19 65236.001 x I2C
QVQLLESGGGLVQPGGSLRLSCAASGFTFSSYAMNWVRQAPGKGLEWVSTISGGGANTYYADSVKGRFTISRDNSKSTLYLQMNSLRAADTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1686 - protein, 5 aa, artificial
  CDR-H1 of CDH19 65236.007
SYAMN

SEQ ID NO: 1687 - protein, 17 aa, artificial
  CDR-H2 of CDH19 65236.007
TISGGGANTYYAESVKG

SEQ ID NO: 1688 - protein, 12 aa, artificial
  CDR-H3 of CDH19 65236.007
GGMGGYYYGMDV

SEQ ID NO: 1689 - protein, 11 aa, artificial
  CDR-L1 of CDH19 65236.007
RASQSISSNLA

SEQ ID NO: 1690 - protein, 7 aa, artificial
  CDR-L2 of CDH19 65236.007
GAFTRAT

SEQ ID NO: 1691 - protein, 9 aa, artificial
  CDR-L3 of CDH19 65236.007
QQYNYWPLT

SEQ ID NO: 1692 - DNA, 363 bp, artificial
  VH of CDH19 65236.007
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcctccgacaactccaagtccaccctgtacctgcagatgaactccctgagagccgaggacaccgccgtgtaccactgtgctaagggcggcatgggcggctactactacggcatggatgtgtggggccagggcaccctcgtgaccgtgtctagc

SEQ ID NO: 1693 - protein, 121 aa, artificial
  VH of CDH19 65236.007
QVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTLVTVSS

SEQ ID NO: 1694 - DNA, 324 bp, artificial
  VL of CDH19 65236.007
gagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagattctctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1695 - protein, 108 aa, artificial
  VL of CDH19 65236.007
EIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS

SEQ ID NO: 1696 - DNA, 732 bp, artificial
  VH-VL of CDH19 65236.007
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcctccgacaactccaagtccaccctgtacctgcagatgaactccctgagagccgaggacaccgccgtgtaccactgtgctaagggcggcatgggcggctactactacggcatggatgtgtggggccagggcaccctcgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagattctctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1697 - protein, 244 aa, artificial
  VH-VL of CDH19 65236.007
QVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS

SEQ ID NO: 1698 - protein, 504 aa, artificial
  CDH19 65236.007 x I2C
QVQLLESGGGLVQPGGSLRLSCAASGFTFSSYAMNWVRQAPGKGLEWVSTISGGGANTYYAESVKGRFTISSDNSKSTLYLQMNSLRAEDTAVYHCAKGGMGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1699 - protein, 5 aa, artificial
  CDR-H1 of CDH19 65236.009
SYAMN

SEQ ID NO: 1700 - protein, 17 aa, artificial
  CDR-H1 of CDH19 65236.009
TISGGGANTYYADSVKG

SEQ ID NO: 1701 - protein, 12 aa, artificial
  CDR-H3 of CDH19 65236.009
GGMGGYYYGMDV

SEQ ID NO: 1702 - protein, 11 aa, artificial
  CDR-L1 of CDH19 65236.009
RASQSISSNLA

SEQ ID NO: 1703 - protein, 7 aa, artificial
  CDR-L2 of CDH19 65236.009
GAFTRAT

SEQ ID NO: 1704 - protein, 9 aa, artificial
  CDR-L3 of CDH19 65236.009
QQYNYWPLT

SEQ ID NO: 1705 - DNA, 363 bp, artificial
  VH of CDH19 65236.009
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgaggacaccgccgtgtactactgtgctaagggcggcatgggcggctactactacggcatggatgtgtggggccagggcaccaccgtgaccgtgtctagc

SEQ ID NO: 1706 - protein, 121 aa, artificial
  VH of CDH19 65236.009
QVQLLESGGGLVQPGGSLRLSCAASGFTFSSYAMNWVRQAPGKGLEWVSTISGGGANTYYADSVKGRFTISRDNSKSTLYLQMNSLRAEDTAVYYCAKGGMGGYYYGMDVWGQGTTVTVSS

SEQ ID NO: 1707 - DNA, 324 bp, artificial; identical to SEQ ID NO: 1681
  VL of CDH19 65236.009

SEQ ID NO: 1708 - protein, 108 aa, artificial; identical to SEQ ID NO: 1682
  VL of CDH19 65236.009

SEQ ID NO: 1709 - DNA, 732 bp, artificial
  VH-VL of CDH19 65236.009
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgaggacaccgccgtgtactactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaagtcc

SEQ ID NO: 1710 - protein, 244 aa, artificial
  VH-VL of CDH19 65236.009
QVQLLESGGGLVQPGGSLRLSCAASGFTFSSYAMNWVRQAPGKGLEWVSTISGGGANTYYADSVKGRFTISRDNSKSTLYLQMNSLRAEDTAVYYCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKS

SEQ ID NO: 1711 - protein, 504 aa, artificial
  CDH19 65236.009 x I2C
QVQLLESGGGLVQPGGSLRLSCAASGFTFSSYAMNWVRQAPGKGLEWVSTISGGGANTYYADSVKGRFTISRDNSKSTLYLQMNSLRAEDTAVYYCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1712 - protein, 5 aa, artificial
  CDR-H1 of CDH19 65236.010
SYAMN

SEQ ID NO: 1713 - protein, 17 aa, artificial
  CDR-H2 of CDH19 65236.010
TISGGGANTYYADSVKG

SEQ ID NO: 1714 - protein, 12 aa, artificial
  CDR-H3 of CDH19 65236.010
GGMGGYYYGMDV

SEQ ID NO: 1715 - protein, 11 aa, artificial
  CDR-L1 of CDH19 65236.010
RASQSISSNLA

SEQ ID NO: 1716 - protein, 7 aa, artificial
  CDR-L2 of CDH19 65236.010
GAFTRAT

SEQ ID NO: 1717 - protein, 9 aa, artificial
  CDR-L3 of CDH19 65236.010
QQYNYWPLT

SEQ ID NO: 1718 - DNA, 363 bp, artificial
  VH of CDH19 65236.010
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccaccgtgaccgtgtctagc

SEQ ID NO: 1719 - protein, 121 aa, artificial
  VH of CDH19 65236.010
QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSS

SEQ ID NO: 1720 - DNA, 324 bp, artificial
  VL of CDH19 65236.010
gagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1721 - protein, 108 aa, artificial
  VL of CDH19 65236.010
EIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKS

SEQ ID NO: 1722 - DNA, 732 bp, artificial
  VH-VL of CDH19 65236.010
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1723 - protein, 244 aa, artificial
  VH-VL of CDH19 65236.010
QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKS

SEQ ID NO: 1724 - protein, 504 aa, artificial
  CDH19 65236.010 x I2C
QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1725 - protein, 5 aa, artificial
  CDR-H1 of CDH19 65236.011
SYAMN

SEQ ID NO: 1726 - protein, 17 aa, artificial
  CDR-H2 of CDH19 65236.011
TISGGGANTYYADSVKG

SEQ ID NO: 1727 - protein, 12 aa, artificial
  CDR-H3 of CDH19 65236.011
GGMGGYYYGMDV

SEQ ID NO: 1728 - protein, 11 aa, artificial
  CDR-L1 of CDH19 65236.011
RASQSISSNLA

SEQ ID NO: 1729 - protein, 7 aa, artificial
  CDR-L2 of CDH19 65236.011
GAFTRAT

SEQ ID NO: 1730 - protein, 9 aa, artificial
  CDR-L3 of CDH19 65236.011
QQYNYWPLT

SEQ ID NO: 1731 - DNA, 363 bp, artificial; identical to SEQ ID NO: 1718
  VH of CDH19 65236.011

SEQ ID NO: 1732 - protein, 121 aa, artificial; identical to SEQ ID NO: 1719
  VH of CDH19 65236.011

SEQ ID NO: 1733 - DNA, 324 bp, artificial; identical to SEQ ID NO: 1694
  VL of CDH19 65236.011

SEQ ID NO: 1734 - protein, 108 aa, artificial; identical to SEQ ID NO: 1695
  VL of CDH19 65236.011

SEQ ID NO: 1735 - DNA, 732 bp, artificial
  VH-VL of CDH19 65236.011
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagattctctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1736 - protein, 244 aa, artificial
  VH-VL of CDH19 65236.011
QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS

SEQ ID NO: 1737 - protein, 504 aa, artificial
  CDH19 65236.011 x I2C
QVQLLESGGGLVQPGGSLRLSCAASGFTFSSYAMNWVRQAPGKGLEWVSTISGGGANTYYADSVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1738 - protein, 5 aa, artificial
  CDR-H1 of CDH19 65236.012
SYAMN

SEQ ID NO: 1739 - protein, 17 aa, artificial
  CDR-H2 of CDH19 65236.012
TISGGGANTYYAESVKG

SEQ ID NO: 1740 - protein, 12 aa, artificial
  CDR-H3 of CDH19 65236.012
GGMGGYYYGMDV

SEQ ID NO: 1741 - protein, 11 aa, artificial
  CDR-L1 of CDH19 65236.012
RASQSISSNLA

SEQ ID NO: 1742 - protein, 7 aa, artificial
  CDR-L2 of CDH19 65236.012
GAFTRAT

SEQ ID NO: 1743 - protein, 9 aa, artificial
  CDR-L3 of CDH19 65236.012
QQYNYWPLT

SEQ ID NO: 1744 - DNA, 363 bp, artificial
  VH of CDH19 65236.012
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccaccgtgaccgtgtctagc

SEQ ID NO: 1745 - protein, 121 aa, artificial
  VH of CDH19 65236.012
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTTVTVSS

SEQ ID NO: 1746 - DNA, 324 bp, artificial; identical to SEQ ID NO: 1694
  VL of CDH19 65236.012

SEQ ID NO: 1747 - protein, 108 aa, artificial; identical to SEQ ID NO: 1695
  VL of CDH19 65236.012

SEQ ID NO: 1748 - DNA, 732 bp, artificial
  VH-VL of CDH19 65236.012
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagattctctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1749 - protein, 244 aa, artificial
  VH-VL of CDH19 65236.012
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS

SEQ ID NO: 1750 - protein, 504 aa, artificial
  CDH19 65236.012 x I2C
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1751 - protein, 5 aa, artificial
  CDR-H1 of CDH19 65236.013
SYAMN

SEQ ID NO: 1752 - protein, 17 aa, artificial
  CDR-H2 of CDH19 65236.013
TISGGGANTYYADSVKG

SEQ ID NO: 1753 - protein, 12 aa, artificial
  CDR-H3 of CDH19 65236.013
GGMGGYYYGMDV

SEQ ID NO: 1754 - protein, 11 aa, artificial
  CDR-L1 of CDH19 65236.013
RASQSISSNLA

SEQ ID NO: 1755 - protein, 7 aa, artificial
  CDR-L2 of CDH19 65236.013
GAFTRAT

SEQ ID NO: 1756 - protein, 9 aa, artificial
  CDR-L3 of CDH19 65236.013
QQYNYWPLT

SEQ ID NO: 1757 - DNA, 363 bp, artificial
  VH of CDH19 65236.013
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgccgacaccgccgtgtactactgtgctaagggcggcatgggcggctactactacggcatggatgtgtggggccagggcaccaccgtgaccgtgtctagc

SEQ ID NO: 1758 - protein, 121 aa, artificial
  VH of CDH19 65236.013
QVQLLESGGGLVQPGGSLRLSCAASGFTFSSYAMNWVRQAPGKGLEWVSTISGGGANTYYADSVKGRFTISRDNSKSTLYLQMNSLRAADTAVYYCAKGGMGGYYYGMDVWGQGTTVTVSS

SEQ ID NO: 1759 - DNA, 324 bp, artificial; identical to SEQ ID NO: 1681
  VL of CDH19 65236.013

SEQ ID NO: 1760 - protein, 108 aa, artificial; identical to SEQ ID NO: 1682
  VL of CDH19 65236.013

SEQ ID NO: 1761 - DNA, 732 bp, artificial
  VH-VL of CDH19 65236.013
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgactccgtgaagggccggttcaccatctcccgcgacaactccaagtccaccctgtacctgcagatgaactccctgagagccgccgacaccgccgtgtactactgtgctaagggcggcatgggcggctactactacggcatggatgtgtggggccagggcaccaccgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagagtgtctggctccggctccggcaccgagttcaccctgaccatcagctccctgcagtccgaggactttgccgtgtactactgccagcagtacaactactggcccctgaccttcggaggcggcaccaaggtggaaatcaagtcc

SEQ ID NO: 1762 - protein, 244 aa, artificial
  VH-VL of CDH19 65236.013
QVQLLESGGGLVQPGGSLRLSCAASGFTFSSYAMNWVRQAPGKGLEWVSTISGGGANTYYADSVKGRFTISRDNSKSTLYLQMNSLRAADTAVYYCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKS

SEQ ID NO: 1763 - protein, 504 aa, artificial
  CDH19 65236.013 x I2C
QVQLLESGGGLVQPGGSLRLSCAASGFTFSSYAMNWVRQAPGKGLEWVSTISGGGANTYYADSVKGRFTISRDNSKSTLYLQMNSLRAADTAVYYCAKGGMGGYYYGMDVWGQGTTVTVSSGGGGSGGGGSGGGGSEIVMTQSPVTLSLSLGERATLSCRASQSISSNLAWFQQKPGQAPRLLIYGAFTRATGIPARVSGSGSGTEFTLTISSLQSEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1764 - protein, 5 aa, artificial
  CDR-H1 of CDH19 65236.014
SYAMN

SEQ ID NO: 1765 - protein, 17 aa, artificial
  CDR-H2 of CDH19 65236.014
TISGGGANTYYAESVKG

SEQ ID NO: 1766 - protein, 12 aa, artificial
  CDR-H3 of CDH19 65236.014
GGMGGYYYGMDV

SEQ ID NO: 1767 - protein, 11 aa, artificial
  CDR-L1 of CDH19 65236.014
RASQSISSNLA

SEQ ID NO: 1768 - protein, 7 aa, artificial
  CDR-L2 of CDH19 65236.014
GAFTRAT

SEQ ID NO: 1769 - protein, 9 aa, artificial
  CDR-L3 of CDH19 65236.014
QQYNYWPLT

SEQ ID NO: 1770 - DNA, 363 bp, artificial
  VH of CDH19 65236.014
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccctcgtgaccgtgtctagc

SEQ ID NO: 1771 - protein, 121 aa, artificial
  VH of CDH19 65236.014
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTLVTVSS

SEQ ID NO: 1772 - DNA, 324 bp, artificial; identical to SEQ ID NO: 1694
  VL of CDH19 65236.014

SEQ ID NO: 1773 - protein, 108 aa, artificial; identical to SEQ ID NO: 1695
  VL of CDH19 65236.014

SEQ ID NO: 1774 - DNA, 732 bp, artificial
  VH-VL of CDH19 65236.014
caggtgcagctgctggaatccggcggaggactggtgcagcctggcggctccctgagactgtcttgcgccgcctccggcttcaccttctccagctacgccatgaactgggtccgacaggcccctggcaagggcctggaatgggtgtccaccatcagcggcggaggcgccaacacctactacgccgagtccgtgaagggccggttcaccatctcccgcgacaactccaagtccaccctgtacctgcagatgaactccctgagagccgaggacaccgccgtgtaccactgtgctaagggcggcatgggcggctactactacggcatggatgtgtggggccagggcaccctcgtgaccgtgtctagcggaggcggaggatctggcggtggtggttctggcggaggcggctccgagatcgtgatgacccagtcccccgtgaccctgtccctgagcctgggcgagagagccaccctgtcttgccgggcctcccagtccatctccagcaacctggcctggttccagcagaagcccggccaggcccctcggctgctgatctacggcgcctttacccgggccaccggcatccctgccagattctctggctccggctccggcaccgagttcaccctgaccatcagctccctggagcccgaggactttgccgtgtactactgccagcagtacaactactggcccctgaccttcggaggcggcaccaaggtggaaatcaagtcc

SEQ ID NO: 1775 - protein, 244 aa, artificial
  VH-VL of CDH19 65236.014
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKS

SEQ ID NO: 1776 - protein, 504 aa, artificial
  CDH19 65236.014 x I2C
QVQLLESGGGLVQPGGSLRLSCAASGFTFSSYAMNWVRQAPGKGLEWVSTISGGGANTYYAESVKGRFTISRDNSKSTLYLQMNSLRAEDTAVYHCAKGGMGGYYYGMDVWGQGTLVTVSSGGGGSGGGGSGGGGSEIVMTQSPVTLSLSLGERATLSCRASQSISSNLAWFQQKPGQAPRLLIYGAFTRATGIPARFSGSGSGTEFTLTISSLEPEDFAVYYCQQYNYWPLTFGGGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1777 - protein, 5 aa, artificial
  CDR-H1 of CDH19 65237.001
RYGIH

SEQ ID NO: 1778 - protein, 17 aa, artificial
  CDR-H2 of CDH19 65237.001
VIWYDGSNKYYADSVKG

SEQ ID NO: 1779 - protein, 16 aa, artificial
  CDR-H3 of CDH19 65237.001
RAGIPGTTGYYYGMDV

SEQ ID NO: 1780 - protein, 11 aa, artificial
  CDR-L1 of CDH19 65237.001
SGDRLGEKYVS

SEQ ID NO: 1781 - protein, 7 aa, artificial
  CDR-L2 of CDH19 65237.001
QDNKWPS

SEQ ID NO: 1782 - protein, 9 aa, artificial
  CDR-L3 of CDH19 65237.001
QAWDSSTVV

SEQ ID NO: 1783 - DNA, 375 bp, artificial
  VH of CDH19 65237.001
caggtgcagctggtggaatccggcggaggcgtggtgcagcctggccggtccctgagactgtcttgcgccgcctccggcttcaccttctccagatacggcatccactgggtccgacaggcccctggcaagggcctggaatgggtggccgtgatttggtacgacggctccaacaagtactacgccgactccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagc

SEQ ID NO: 1784 - protein, 125 aa, artificial; identical to SEQ ID NO: 513
  VH of CDH19 65237.001

SEQ ID NO: 1785 - DNA, 321 bp, artificial
  VL of CDH19 65237.001
tcttacgagctgacccagcccccctccgtgtccgtgtctcctggccagaccgcctccatcacctgttctggcgaccggctgggcgagaaatacgtgagctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 1786 - protein, 107 aa, artificial
  VL of CDH19 65237.001
SYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLS

SEQ ID NO: 1787 - DNA, 741 bp, artificial
  VH-VL of CDH19 65237.001
caggtgcagctggtggaatccggcggaggcgtggtgcagcctggccggtccctgagactgtcttgcgccgcctccggcttcaccttctccagatacggcatccactgggtccgacaggcccctggcaagggcctggaatgggtggccgtgatttggtacgacggctccaacaagtactacgccgactccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaaatacgtgagctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 1788 - protein, 247 aa, artificial
  VH-VL of CDH19 65237.001
QVQLVESGGGVVQPGRSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLS

SEQ ID NO: 1789 - protein, 507 aa, artificial; identical to SEQ ID NO: 1242
  CDH19 65237.001 x I2C

SEQ ID NO: 1790 - protein, 5 aa, artificial
  CDR-H1 of CDH19 65237b.001
RYGIH

SEQ ID NO: 1791 - protein, 17 aa, artificial
  CDR-H2 of CDH19 65237b.001
VIWYEGSNKYYAESVKG

SEQ ID NO: 1792 - protein, 16 aa, artificial
  CDR-H3 of CDH19 65237b.001
RAGIPGTTGYYYGMDV

SEQ ID NO: 1793 - protein, 11 aa, artificial
  CDR-L1 of CDH19 65237b.001
SGDRLGEKYVS

SEQ ID NO: 1794 - protein, 7 aa, artificial
  CDR-L2 of CDH19 65237b.001
QDNKWPS

SEQ ID NO: 1795 - protein, 9 aa, artificial
  CDR-L3 of CDH19 65237b.001
QAWESSTVV

SEQ ID NO: 1796 - DNA, 375 bp, artificial
  VH of CDH19 65237b.001
caggtgcagctggtggaatccggcggaggcgtggtgcagcctggcgggtccctgagactgtcttgcgccgcctccggcttcaccttctccagatacggcatccactgggtccgacaggcccctggcaagggcctggaatgggtggccgtgatttggtacgagggctccaacaagtactacgccgagtccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagc

SEQ ID NO: 1797 - protein, 125 aa, artificial; identical to SEQ ID NO: 515
  VH of CDH19 65237b.001

SEQ ID NO: 1798 - DNA, 321 bp, artificial
  VL of CDH19 65237b.001
tcttacgagctgacccagcccccctccgtgtccgtgtctcctggccagaccgcctccatcacctgttctggcgaccggctgggcgagaaatacgtgagctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggagtcctccaccgtggtgttcggcggaggcaccaagctgaccgtgctgtcc

SEQ ID NO: 1799 - protein, 107 aa, artificial
  VL of CDH19 65237b.001
SYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLS

SEQ ID NO: 1800 - DNA, 741 bp, artificial
  VH-VL of CDH19 65237b.001
caggtgcagctggtggaatccggcggaggcgtggtgcagcctggcgggtccctgagactgtcttgcgccgcctccggcttcaccttctccagatacggcatccactgggtccgacaggcccctggcaagggcctggaatgggtggccgtgatttggtacgagggctccaacaagtactacgccgagtccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaaatacgtgagctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggagtcctccaccgtggtgttcggcggaggcaccaagctgaccgtgctgtcc

SEQ ID NO: 1801 - protein, 247 aa, artificial
  VH-VL of CDH19 65237b.001
QVQLVESGGGVVQPGGSLRLSCAASGFTFSRYGIHWVRQAPGKGLEWVAVIWYEGSNKYYAESVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWESSTVVFGGGTKLTVLS

SEQ ID NO: 1802 - protein, 507 aa, artificial; identical to SEQ ID NO: 1229
  CDH19 65237b.001 x I2C

SEQ ID NO: 1803 - protein, 5 aa, artificial
  CDR-H1 of CDH19 65237.002
RYGIH

SEQ ID NO: 1804 - protein, 17 aa, artificial
  CDR-H2 of CDH19 65237.002
VIWYDGSNKYYADSVKG

SEQ ID NO: 1805 - protein, 16 aa, artificial
  CDR-H3 of CDH19 65237.002
RAGIPGTTGYYYGMDV

SEQ ID NO: 1806 - protein, 11 aa, artificial
  CDR-L1 of CDH19 65237.002
SGDRLGEKYVS

SEQ ID NO: 1807 - protein, 7 aa, artificial
  CDR-L2 of CDH19 65237.002
QDNKWPS

SEQ ID NO: 1808 - protein, 9 aa, artificial
  CDR-L3 of CDH19 65237.002
QAWDSSTVV

SEQ ID NO: 1809 - DNA, 375 bp, artificial
  VH of CDH19 65237.002
caggtgcagctggtggaatccggcggaggcgtggtgcagcctggcgggtccctgagactgtcttgcgccgcctccggcttcaccttctccagatacggcatccactgggtccgacaggcccctggcaagggcctggaatgggtggccgtgatttggtacgacggctccaacaagtactacgccgactccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagc

SEQ ID NO: 1810 - protein, 125 aa, artificial; identical to SEQ ID NO: 514
  VH of CDH19 65237.002

SEQ ID NO: 1811 - DNA, 321 bp, artificial; identical to SEQ ID NO: 1785
  VL of CDH19 65237.002

SEQ ID NO: 1812 - protein, 107 aa, artificial; identical to SEQ ID NO: 1786
  VL of CDH19 65237.002

SEQ ID NO: 1813 - DNA, 741 bp, artificial
  VH-VL of CDH19 65237.002
caggtgcagctggtggaatccggcggaggcgtggtgcagcctggcgggtccctgagactgtcttgcgccgcctccggcttcaccttctccagatacggcatccactgggtccgacaggcccctggcaagggcctggaatgggtggccgtgatttggtacgacggctccaacaagtactacgccgactccgtgaagggccggttcaccatctcccgggacaactccaagaacaccctgtacctgcagatgaactccctgcgggccgaggactccgccgtgtactactgtgccagaagggccggcatccccggcaccaccggctactactacggcatggatgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaaatacgtgagctggtatcagcagaagcccggccagtcccccatcctggtcatctaccaggacaacaagtggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 1814 - protein, 247 aa, artificial
  VH-VL of CDH19 65237.002
QVQLVESGGGVVQPGGSLRLSCAASGFTFSRYGIHWVRQAPGKGLEWVAVIWYDGSNKYYADSVKGRFTISRDNSKNTLYLQMNSLRAEDSAVYYCARRAGIPGTTGYYYGMDVWGQGTTVTVSSGGGGSGGGGSGGGGSSYELTQPPSVSVSPGQTASITCSGDRLGEKYVSWYQQKPGQSPILVIYQDNKWPSGIPERFSGSNSGNTATLTISGTQAMDEADYYCQAWDSSTVVFGGGTKLTVLS

SEQ ID NO: 1815 - protein, 507 aa, artificial; identical to SEQ ID NO: 1411
  CDH19 65237.002 x I2C

SEQ ID NO: 1816 - protein, 7 aa, artificial
  CDR-H1 of CDH19 65238.002
SSGYYWS

SEQ ID NO: 1817 - protein, 16 aa, artificial
  CDR-H2 of CDH19 65238.002
YIYYTGSAYYNPSLKS

SEQ ID NO: 1818 - protein, 10 aa, artificial
  CDR-H3 of CDH19 65238.002
DGSSGWYFQY

SEQ ID NO: 1819 - protein, 12 aa, artificial
  CDR-L1 of CDH19 65238.002
RASRQISSSYLA

SEQ ID NO: 1820 - protein, 7 aa, artificial
  CDR-L2 of CDH19 65238.002
GPSSRAT

SEQ ID NO: 1821 - protein, 8 aa, artificial
  CDR-L3 of CDH19 65238.002
QQYGSSFT

SEQ ID NO: 1822 - DNA, 360 bp, artificial
  VH of CDH19 65238.002
caggtgcagctgcaggaatccggccctggcctggtcaagccctccgagaccctgtccctgacctgcaccgtgtccggcggctccatctcctcctccggctactactggtcctggatccggcagccccccggcaagggcctggaatggatcggctacatctactacaccggctccgcctactacaaccccagcctgaagtccagagtgaccatctccgtggacacctccaagaaccagttctccctgaagctgtcctccgtgaccgccgctgacaccgccgtgtactactgcgccagagatggctccagcggctggtacttccagtactggggccagggcaccctggtcaccgtgtctagc

SEQ ID NO: 1823 - protein, 120 aa, artificial; identical to SEQ ID NO: 464
  VH of CDH19 65238.002

SEQ ID NO: 1824 - DNA, 324 bp, artificial
  VL of CDH19 65238.002
gagatcgtgctgacccagtcccccggcaccctgtctctgagccctggcgagagagccaccctgtcctgccgggcctcccggcagatctcctccagctacctggcttggtatcagcagaagcccggccaggcccctcggctgctgatctacggccctagctccagagccaccggcatccctgaccggttctccggctctggctccggcaccgacttcaccctgaccatcagccggctggaacccgaggacttcgccgtgtactattgccagcagtacggctcctccttcaccttcggccagggcaccaaggtggacatcaagtcc

SEQ ID NO: 1825 - protein, 108 aa, artificial
  VL of CDH19 65238.002
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKS

SEQ ID NO: 1826 - DNA, 729 bp, artificial
  VH-VL of CDH19 65238.002
caggtgcagctgcaggaatccggccctggcctggtcaagccctccgagaccctgtccctgacctgcaccgtgtccggcggctccatctcctcctccggctactactggtcctggatccggcagccccccggcaagggcctggaatggatcggctacatctactacaccggctccgcctactacaaccccagcctgaagtccagagtgaccatctccgtggacacctccaagaaccagttctccctgaagctgtcctccgtgaccgccgctgacaccgccgtgtactactgcgccagagatggctccagcggctggtacttccagtactggggccagggcaccctggtcaccgtgtctagcggaggcggaggatctggtggcggtggttctggcggcggaggctccgagatcgtgctgacccagtcccccggcaccctgtctctgagccctggcgagagagccaccctgtcctgccgggcctcccggcagatctcctccagctacctggcttggtatcagcagaagcccggccaggcccctcggctgctgatctacggccctagctccagagccaccggcatccctgaccggttctccggctctggctccggcaccgacttcaccctgaccatcagccggctggaacccgaggacttcgccgtgtactattgccagcagtacggctcctccttcaccttcggccagggcaccaaggtggacatcaagtcc

SEQ ID NO: 1827 - protein, 243 aa, artificial
  VH-VL of CDH19 65238.002
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSGGGGSGGGGSGGGGSEIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGQGTKVDIKS

SEQ ID NO: 1828 - protein, 503 aa, artificial; identical to SEQ ID NO: 1320
  CDH19 65238.002 x I2C

SEQ ID NO: 1829 - protein, 7 aa, artificial
  CDR-H1 of CDH19 65238.004
SSGYYWS

SEQ ID NO: 1830 - protein, 16 aa, artificial
  CDR-H2 of CDH19 65238.004
YIYYTGSAYYNPSLKS

SEQ ID NO: 1831 - protein, 10 aa, artificial
  CDR-H3 of CDH19 65238.004
DGSSGWYFQY

SEQ ID NO: 1832 - protein, 12 aa, artificial
  CDR-L1 of CDH19 65238.004
RASRQISSSYLA

SEQ ID NO: 1833 - protein, 7 aa, artificial
  CDR-L2 of CDH19 65238.004
GPSSRAT

SEQ ID NO: 1834 - protein, 8 aa, artificial
  CDR-L3 of CDH19 65238.004
QQYGSSFT

SEQ ID NO: 1835 - DNA, 360 bp, artificial; identical to SEQ ID NO: 1822
  VH of CDH19 65238.004

SEQ ID NO: 1836 - protein, 120 aa, artificial; identical to SEQ ID NO: 464
  VH of CDH19 65238.004

SEQ ID NO: 1837 - DNA, 324 bp, artificial
  VL of CDH19 65238.004
gagatcgtgctgacccagtcccccggcaccctgtctctgagccctggcgagagagccaccctgtcctgccgggcctcccggcagatctcctccagctacctggcttggtatcagcagaagcccggccaggcccctcggctgctgatctacggccctagctccagagccaccggcatccctgaccggttctccggctctggctccggcaccgacttcaccctgaccatcagccggctggaacccgaggacttcgccgtgtactattgccagcagtacggctcctccttcaccttcggccctggcaccaaggtggacatcaagtcc

SEQ ID NO: 1838 - protein, 108 aa, artificial
  VL of CDH19 65238.004
EIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKS

SEQ ID NO: 1839 - DNA, 729 bp, artificial
  VH-VL of CDH19 65238.004
caggtgcagctgcaggaatccggccctggcctggtcaagccctccgagaccctgtccctgacctgcaccgtgtccggcggctccatctcctcctccggctactactggtcctggatccggcagccccccggcaagggcctggaatggatcggctacatctactacaccggctccgcctactacaaccccagcctgaagtccagagtgaccatctccgtggacacctccaagaaccagttctccctgaagctgtcctccgtgaccgccgctgacaccgccgtgtactactgcgccagagatggctccagcggctggtacttccagtactggggccagggcaccctggtcaccgtgtctagcggaggcggaggatctggtggcggtggttctggcggcggaggctccgagatcgtgctgacccagtcccccggcaccctgtctctgagccctggcgagagagccaccctgtcctgccgggcctcccggcagatctcctccagctacctggcttggtatcagcagaagcccggccaggcccctcggctgctgatctacggccctagctccagagccaccggcatccctgaccggttctccggctctggctccggcaccgacttcaccctgaccatcagccggctggaacccgaggacttcgccgtgtactattgccagcagtacggctcctccttcaccttcggccctggcaccaaggtggacatcaagtcc

SEQ ID NO: 1840 - protein, 243 aa, artificial
  VH-VL of CDH19 65238.004
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSGGGGSGGGGSGGGGSEIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKS

SEQ ID NO: 1841 - protein, 503 aa, artificial
  CDH19 65238.004 x I2C
QVQLQESGPGLVKPSETLSLTCTVSGGSISSSGYYWSWIRQPPGKGLEWIGYIYYTGSAYYNPSLKSRVTISVDTSKNQFSLKLSSVTAADTAVYYCARDGSSGWYFQYWGQGTLVTVSSGGGGSGGGGSGGGGSEIVLTQSPGTLSLSPGERATLSCRASRQISSSYLAWYQQKPGQAPRLLIYGPSSRATGIPDRFSGSGSGTDFTLTISRLEPEDFAVYYCQQYGSSFTFGPGTKVDIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1842 - protein, 5 aa, artificial
  CDR-H1 of CDH19 65240.002
SYDMH

SEQ ID NO: 1843 - protein, 17 aa, artificial
  CDR-H2 of CDH19 65240.002
VISYDGTNEYYADSVKG

SEQ ID NO: 1844 - protein, 10 aa, artificial
  CDR-H3 of CDH19 65240.002
ERYFDWSFDY

SEQ ID NO: 1845 - protein, 12 aa, artificial
  CDR-L1 of CDH19 65240.002
RASQSVSNTYLA

SEQ ID NO: 1846 - protein, 7 aa, artificial
  CDR-L2 of CDH19 65240.002
GASSRAT

SEQ ID NO: 1847 - protein, 8 aa, artificial
  CDR-L3 of CDH19 65240.002
QQYSNSWT

SEQ ID NO: 1848 - DNA, 357 bp, artificial
  VH of CDH19 65240.002
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgacggcaccaacgagtactacgccgactccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagc

SEQ ID NO: 1849 - protein, 119 aa, artificial; identical to SEQ ID NO: 490
  VH of CDH19 65240.002

SEQ ID NO: 1850 - DNA, 324 bp, artificial
  VL of CDH19 65240.002
gagatcgtgctgacccagtcccctggcaccctgtccctgagccctggcgagagagccaccctgtcttgccgggcctcccagtccgtgtccaacacctacctggcctggtatcagcagcgccctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1851 - protein, 108 aa, artificial
  VL of CDH19 65240.002
EIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKS

SEQ ID NO: 1852 - DNA, 726 bp, artificial
  VH-VL of CDH19 65240.002
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgacggcaccaacgagtactacgccgactccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagcggaggcggaggatctggtggcggtggttctggcggcggaggctccgagatcgtgctgacccagtcccctggcaccctgtccctgagccctggcgagagagccaccctgtcttgccgggcctcccagtccgtgtccaacacctacctggcctggtatcagcagcgccctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1853 - protein, 242 aa, artificial
  VH-VL of CDH19 65240.002
QVQLVESGGGVVQPGGSLRLSCAASGFTFSSYDMHWVRQAPGKGLEWVAVISYDGTNEYYADSVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKS

SEQ ID NO: 1854 - protein, 502 aa, artificial; identical to SEQ ID NO: 1333
  CDH19 65240.002 x I2C

SEQ ID NO: 1855 - protein, 5 aa, artificial
  CDR-H1 of CDH19 65240.003
SYDMH

SEQ ID NO: 1856 - protein, 17 aa, artificial
  CDR-H2 of CDH19 65240.003
VISYEGTNEYYAESVKG

SEQ ID NO: 1857 - protein, 10 aa, artificial
  CDR-H3 of CDH19 65240.003
ERYFDWSFDY

SEQ ID NO: 1858 - protein, 12 aa, artificial
  CDR-L1 of CDH19 65240.003
RASQSVSNTYLA

SEQ ID NO: 1859 - protein, 7 aa, artificial
  CDR-L2 of CDH19 65240.003
GASSRAT

SEQ ID NO: 1860 - protein, 8 aa, artificial
  CDR-L3 of CDH19 65240.003
QQYSNSWT

SEQ ID NO: 1861 - DNA, 357 bp, artificial
  VH of CDH19 65240.003
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgagggcaccaacgagtactacgccgagtccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagc

SEQ ID NO: 1862 - protein, 119 aa, artificial; identical to SEQ ID NO: 491
  VH of CDH19 65240.003

SEQ ID NO: 1863 - protein, 324 aa, artificial
  VL of CDH19 65240.003
GAGATCGTGCTGACCCAGTCCCCTGGCACCCTGTCCCTGAGCCCTGGCGAGAGAGCCACCCTGTCTTGCCGGGCCTCCCAGTCCGTGTCCAACACCTACCTGGCCTGGTATCAGCAGCGCCCTGGCCAGGCCCCTCGGCTGCTGATCTACGGCGCCTCTTCCAGAGCCACCGGCATCCCTGACCGGTTCTCCGGCTCTGGCTCTGGCACCGACTTCACCCTGACCATCTCCAGCCTGGAACCCGAGGATTTCGCTGTGTACTATTGCCAGCAGTACTCCAACTCCTGGACCTTCGGACAGGGCACCAAGGTGGAAATCAAGTCC

SEQ ID NO: 1864 - protein, 108 aa, artificial; identical to SEQ ID NO: 1851
  VL of CDH19 65240.003

SEQ ID NO: 1865 - DNA, 726 bp, artificial
  VH-VL of CDH19 65240.003
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgagggcaccaacgagtactacgccgagtccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagcggaggcggaggatctggtggcggtggttctggcggcggaggctccgagatcgtgctgacccagtcccctggcaccctgtccctgagccctggcgagagagccaccctgtcttgccgggcctcccagtccgtgtccaacacctacctggcctggtatcagcagcgccctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1866 - protein, 242 aa, artificial
  VH-VL of CDH19 65240.003
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKS

SEQ ID NO: 1867 - protein, 502 aa, artificial
  CDH19 65240.003 x I2C
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQRPGQAPRLLIYGASSRATGIPDRFSGSGSGTDFTLTISSLEPEDFAVYYCQQYSNSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1868 - protein, 5 aa, artificial
  CDR-H1 of CDH19 65240.004
SYDMH

SEQ ID NO: 1869 - protein, 17 aa, artificial
  CDR-H2 of CDH19 65240.004
VISYEGTNEYYAESVKG

SEQ ID NO: 1870 - protein, 10 aa, artificial
  CDR-H3 of CDH19 65240.004
ERYFDWSFDY

SEQ ID NO: 1871 - protein, 12 aa, artificial
  CDR-L1 of CDH19 65240.004
RASQSVSNTYLA

SEQ ID NO: 1872 - protein, 7 aa, artificial
  CDR-L2 of CDH19 65240.004
GASSRAT

SEQ ID NO: 1873 - protein, 8 aa, artificial
  CDR-L3 of CDH19 65240.004
QQYSNSWT

SEQ ID NO: 1874 - DNA, 357 bp, artificial; identical to SEQ ID NO: 1861
  VH of CDH19 65240.004

SEQ ID NO: 1875 - protein, 119 aa, artificial; identical to SEQ ID NO: 491
  VH of CDH19 65240.004

SEQ ID NO: 1876 - DNA, 324 bp, artificial
  VL of CDH19 65240.004
gagatcgtgctgacccagtcccctggcaccctgtccctgagccctggcgagagagccaccctgtcttgccgggcctcccagtccgtgtccaacacctacctggcctggtatcagcagaagcctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1877 - protein, 108 aa, artificial
  VL of CDH19 65240.004
EIVLTQSPGTLSLSPGERATLSCRASQSVSNTYLAWYQQKPGQAPRLLIYGASSRATGIPDRFSGSGSGTDFTLTISSLEPEDFAVYYCQQYSNSWTFGQGTKVEIKS

SEQ ID NO: 1878 - DNA, 726 bp, artificial
  VH-VL of CDH19 65240.004
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgagggcaccaacgagtactacgccgagtccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgtccgtgtctagcggaggcggaggatctggtggcggtggttctggcggcggaggctccgagatcgtgctgacccagtcccctggcaccctgtccctgagccctggcgagagagccaccctgtcttgccgggcctcccagtccgtgtccaacacctacctggcctggtatcagcagaagcctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1879 - protein, 242 aa, artificial
  VH-VL of CDH19 65240.004
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQKPGQAPRLLIYGASSRATGIPDRFSGSGSGTDFTLTISSLEPEDFAVYYCQQYSNSWTFGQGTKVEIKS

SEQ ID NO: 1880 - protein, 502 aa, artificial
  CDH19 65240.004 x I2C
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVSVSSGGGGSGGGGSGGGGSEIVLTQSPGTLSLSPGERATLSCRASQSVSNTYLAWYQQKPGQAPRLLIYGASSRATGIPDRFSGSGSGTDFTLTISSLEPEDFAVYYCQQYSNSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1881 - protein, 5 aa, artificial
  CDR-H1 of CDH19 65240.005
SYDMH

SEQ ID NO: 1882 - protein, 17 aa, artificial
  CDR-H2 of CDH19 65240.005
VISYEGTNEYYAESVKG

SEQ ID NO: 1883 - protein, 10 aa, artificial
  CDR-H3 of CDH19 65240.005
ERYFDWSFDY

SEQ ID NO: 1884 - protein, 12 aa, artificial
  CDR-L1 of CDH19 65240.005
RASQSVSNTYLA

SEQ ID NO: 1885 - protein, 7 aa, artificial
  CDR-L2 of CDH19 65240.005
GASSRAT

SEQ ID NO: 1886 - protein, 8 aa, artificial
  CDR-L3 of CDH19 65240.005
QQYSNSWT

SEQ ID NO: 1887 - DNA, 357 bp, artificial
  VH of CDH19 65240.005
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgagggcaccaacgagtactacgccgagtccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgaccgtgtctagc

SEQ ID NO: 1888 - protein, 119 aa, artificial
  VH of CDH19 65240.005
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVTVSS

SEQ ID NO: 1889 - DNA, 324 bp, artificial; identical to SEQ ID NO: 1876
  VL of CDH19 65240.005

SEQ ID NO: 1890 - protein, 108 aa, artificial; identical to SEQ ID NO: 1877
  VL of CDH19 65240.005

SEQ ID NO: 1891 - DNA, 726 bp, artificial
  VH-VL of CDH19 65240.005
caggtgcagctggtggaatccggcggaggcgtggtgcagcctggcgggtccctgagactgtcttgcgccgcctccggcttcaccttctccagctacgacatgcactgggtccgacaggcccctggcaagggcctggaatgggtggccgtgatctcctacgagggcaccaacgagtactacgccgagtccgtgaagggccggttcaccatctcccgggacacctccaagaacaccctgtacctgcagatgaactccctgcgggccgaggacaccgccgtgtactactgcgccagagagcggtacttcgactggtccttcgactactggggccagggcaccctggtgaccgtgtctagcggaggcggaggatctggtggcggtggttctggcggcggaggctccgagatcgtgctgacccagtcccctggcaccctgtccctgagccctggcgagagagccaccctgtcttgccgggcctcccagtccgtgtccaacacctacctggcctggtatcagcagaagcctggccaggcccctcggctgctgatctacggcgcctcttccagagccaccggcatccctgaccggttctccggctctggctctggcaccgacttcaccctgaccatctccagcctggaacccgaggatttcgctgtgtactattgccagcagtactccaactcctggaccttcggacagggcaccaaggtggaaatcaagtcc

SEQ ID NO: 1892 - protein, 242 aa, artificial
  VH-VL of CDH19 65240.005
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVTVSSGGGGSGGGGSGGGGSEIVLTQSPGTLSLSPGERATLSCRASQSVSNTYLAWYQQKPGQAPRLLIYGASSRATGIPDRFSGSGSGTDFTLTISSLEPEDFAVYYCQQYSNSWTFGQGTKVEIKS

SEQ ID NO: 1893 - protein, 502 aa, artificial
  CDH19 65240.005 x I2C
QVQLVESGGGVVQPGGSLRLSCAASGFTFSSYDMHWVRQAPGKGLEWVAVISYEGTNEYYAESVKGRFTISRDTSKNTLYLQMNSLRAEDTAVYYCARERYFDWSFDYWGQGTLVTVSSGGGGSGGGGSGGGGSEIVLTQSPGTLSLSPGERATLSCRASQSVSNTYLAWYQQKPGQAPRLLIYGASSRATGIPDRFSGSGSGTDFTLTISSLEPEDFAVYYCQQYSNSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1894 - protein, 5 aa, artificial
  CDR-H1 of CDH19 65246.004
SYFIH

SEQ ID NO: 1895 - protein, 17 aa, artificial
  CDR-H2 of CDH19 65246.004
IINPISVSTSYAQKFQG

SEQ ID NO: 1896 - protein, 11 aa, artificial
  CDR-H3 of CDH19 65246.004
GGIQLWLHFDY

SEQ ID NO: 1897 - protein, 13 aa, artificial
  CDR-L1 of CDH19 65246.004
SGSSSNIGSNFVN

SEQ ID NO: 1898 - protein, 7 aa, artificial
  CDR-L2 of CDH19 65246.004
TNNQRPS

SEQ ID NO: 1899 - protein, 11 aa, artificial
  CDR-L3 of CDH19 65246.004
ATWDESLQGWV

SEQ ID NO: 1900 - DNA, 360 bp, artificial
  VH of CDH19 65246.004
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacttcgactactggggccagggcaccctggtcaccgtgtctagc

SEQ ID NO: 1901 - protein, 120 aa, artificial
  VH of CDH19 65246.004
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHFDYWGQGTLVTVSS

SEQ ID NO: 1902 - DNA, 333 bp, artificial
  VL of CDH19 65246.004
cagtctgccctgacccagcctccttctgccaccggcacccctggccagcgcgtgaccatctcctgctccggctcctcctccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgagtccctgcagggctgggtgttcggcggaggcaccaagctgaccgtgctgtcc

SEQ ID NO: 1903 - protein, 111 aa, artificial
  VL of CDH19 65246.004
QSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLS

SEQ ID NO: 1904 - DNA, 738 bp, artificial
  VH-VL of CDH19 65246.004
caggtgcagctggtgcagtctggcgccgaagtgaagaaacctggcgcctccgtgaaggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctctcagtctgccctgacccagcctccttctgccaccggcacccctggccagcgcgtgaccatctcctgctccggctcctcctccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctgggacgagtccctgcagggctgggtgttcggcggaggcaccaagctgaccgtgctgtcc

SEQ ID NO: 1905 - protein, 246 aa, artificial
  VH-VL of CDH19 65246.004
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHFDYWGQGTLVTVSSGGGGSGGGGSGGGGSQSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLS

SEQ ID NO: 1906 - protein, 506 aa, artificial
  CDH19 65246.004 x I2C
QVQLVQSGAEVKKPGASVKVSCKVSGYTFTSYFIHWVRQAPGQGLEWMGIINPISVSTSYAQKFQGRVTMTRDTSTSTVYMELSSLRSEDTAVYYCARGGIQLWLHFDYWGQGTLVTVSSGGGGSGGGGSGGGGSQSALTQPPSATGTPGQRVTISCSGSSSNIGSNFVNWYQQLPGTAPKVLIYTNNQRPSGVPDRFSGSKSGTSASLAISGLQSEDEADYYCATWDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1907 - protein, 5 aa, artificial
  CDR-H1 of CDH19 65247.004
SYFIH

SEQ ID NO: 1908 - protein, 17 aa, artificial
  CDR-H2 of CDH19 65247.004
IINPISVSTSYAQKFQG

SEQ ID NO: 1909 - protein, 11 aa, artificial
  CDR-H3 of CDH19 65247.004
GGIQLWLHLDY

SEQ ID NO: 1910 - protein, 13 aa, artificial
  CDR-L1 of CDH19 65247.004
SGSSSNIGSNFVN

SEQ ID NO: 1911 - protein, 7 aa, artificial
  CDR-L2 of CDH19 65247.004
TNNQRPS

SEQ ID NO: 1912 - protein, 11 aa, artificial
  CDR-L3 of CDH19 65247.004
ATYDESMQGWV

SEQ ID NO: 1913 - DNA, 360 bp, artificial
  VH of CDH19 65247.004
caggtgcagctggtgcagtctggcgccgaagtgaagaaacctggcgcctccgtgcgggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacctggactattggggccagggcaccctggtcaccgtgtcctct

SEQ ID NO: 1914 - protein, 120 aa, artificial; identical to SEQ ID NO: 538
  VH of CDH19 65247.004

SEQ ID NO: 1915 - DNA, 333 bp, artificial
  VL of CDH19 65247.004
cagtctgccctgacccagcctccttccgctaccggcacccctggccagcgcgtgaccatctcctgctccggctcctcctccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctacgacgagtccatgcagggctgggtgttcggcggaggcaccaagctgaccgtgctgtcc

SEQ ID NO: 1916 - protein, 111 aa, artificial
  VL of CDH19 65247.004
QSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLS

SEQ ID NO: 1917 - DNA, 738 bp, artificial
  VH-VL of CDH19 65247.004
caggtgcagctggtgcagtctggcgccgaagtgaagaaacctggcgcctccgtgcgggtgtcctgcaaggtgtccggctacaccttcaccagctacttcatccactgggtccgacaggccccaggccagggcctggaatggatgggcatcatcaaccctatctccgtgtccacctcctacgcccagaaattccagggcagagtgaccatgacccgggacacctccacctccaccgtgtacatggaactgtcctccctgcggagcgaggacaccgccgtgtactactgcgccagaggcggcatccagctgtggctgcacctggactattggggccagggcaccctggtcaccgtgtcctctggtggcggaggatctggcggaggtggaagcggaggcggcggatctcagtctgccctgacccagcctccttccgctaccggcacccctggccagcgcgtgaccatctcctgctccggctcctcctccaacatcggctccaacttcgtgaactggtaccagcagctgcccggcaccgcccccaaggtgctgatctacaccaacaaccagcggccctccggcgtgcccgaccggttctctggctccaagtctggcacctccgcctccctggccatctccggcctgcagtccgaggacgaggccgactactactgtgccacctacgacgagtccatgcagggctgggtgttcggcggaggcaccaagctgaccgtgctgtcc

SEQ ID NO: 1918 - protein, 246 aa, artificial
  VH-VL of CDH19 65247.004
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSGGGGSGGGGSGGGGSQSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLS

SEQ ID NO: 1919 - protein, 506 aa, artificial
  CDH19 65247.004 x I2C
QVQLVQSGAEVKKPGASVRVSCKVSGYTFTSYFIHWVRQAPGQGLEWMGIINPISVSTSYAQKFQGRVTMTRDTSTSTVYMELSSLRSEDTAVYYCARGGIQLWLHLDYWGQGTLVTVSSGGGGSGGGGSGGGGSQSALTQPPSATGTPGQRVTISCSGSSSNIGSNFVNWYQQLPGTAPKVLIYTNNQRPSGVPDRFSGSKSGTSASLAISGLQSEDEADYYCATYDESMQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1920 - protein, 5 aa, artificial
  CDR-H1 of CDH19 65249.002
GYYWS

SEQ ID NO: 1921 - protein, 16 aa, artificial
  CDR-H2 of CDH19 65249.002
YIYYIGSTNYNPSLKS

SEQ ID NO: 1922 - protein, 12 aa, artificial
  CDR-H3 of CDH19 65249.002
DGSSGWYRWFDP

SEQ ID NO: 1923 - protein, 12 aa, artificial
  CDR-L1 of CDH19 65249.002
RASQSVSSSYLA

SEQ ID NO: 1924 - protein, 7 aa, artificial
  CDR-L2 of CDH19 65249.002
GASSRAT

SEQ ID NO: 1925 - protein, 9 aa, artificial
  CDR-L3 of CDH19 65249.002
QQYGNSPLT

SEQ ID NO: 1926 - DNA, 360 bp, artificial; identical to SEQ ID NO: 1093
  VH of CDH19 65249.002

SEQ ID NO: 1927 - protein, 120 aa, artificial; identical to SEQ ID NO: 461
  VH of CDH19 65249.002

SEQ ID NO: 1928 - DNA, 327 bp, artificial
  VL of CDH19 65249.002
gagatcgtgctgacccagtcccctggcaccctgtccctgagccctggcgagagagccaccctgtcctgcagagcctcccagtccgtgtcctcctcctacctggcttggtatcagcagaagcccggccaggcccctcggctgctgatcttcggcgcctcttccagagccaccggcatccctgaccggttctccggctctggctccggcaccgacttcaccctgaccatctcccggctggaacccgaggacttcgctgtgtactactgccagcagtacggcaacagccccctgaccttcggccaaggcaccaaggtggaaatcaagtcc

SEQ ID NO: 1929 - protein, 109 aa, artificial
  VL of CDH19 65249.002
EIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKS

SEQ ID NO: 1930 - DNA, 732 bp, artificial
  VH-VL of CDH19 65249.002
caggtgcagctgcaggaatccggccctggcctggtcaagccctccgagacactgtccctgacctgcaccgtgtccggcggctccatctccggctactactggtcctggatccggcagccccctggcaagggcctggaatggatcggctacatctactacatcggctccaccaactacaaccccagcctgaagtccagagtgaccatgtccgtggacacctccaagaaccagttctccctgaagctgtcctccgtgaccgccgctgacaccgccgtgtactactgcgccagagatggctcctccggctggtatcgttggttcgacccttggggccagggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcttggtatcagcagaagcccggccaggcccctcggctgctgatcttcggcgcctcttccagagccaccggcatccctgaccggttctccggctctggctccggcaccgacttcaccctgaccatctcccggctggaacccgaggacttcgctgtgtactactgccagcagtacggcaacagccccctgaccttcggccaaggcaccaaggtggaaatcaagtcc

SEQ ID NO: 1931 - protein, 244 aa, artificial
  VH-VL of CDH19 65249.002
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSGGGGSGGGGSGGGGSEIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKS

SEQ ID NO: 1932 - protein, 504 aa, artificial
  CDH19 65249.002 x I2C
QVQLQESGPGLVKPSETLSLTCTVSGGSISGYYWSWIRQPPGKGLEWIGYIYYIGSTNYNPSLKSRVTMSVDTSKNQFSLKLSSVTAADTAVYYCARDGSSGWYRWFDPWGQGTLVTVSSGGGGSGGGGSGGGGSEIVLTQSPGTLSLSPGERATLSCRASQSVSSSYLAWYQQKPGQAPRLLIFGASSRATGIPDRFSGSGSGTDFTLTISRLEPEDFAVYYCQQYGNSPLTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1933 - protein, 5 aa, artificial
  CDR-H1 of CDH19 65250.003
SYYMS

SEQ ID NO: 1934 - protein, 17 aa, artificial
  CDR-H2 of CDH19 65250.003
IIHPSGGDTTYAQKFQG

SEQ ID NO: 1935 - protein, 11 aa, artificial
  CDR-H3 of CDH19 65250.003
GGIKLWLHFDY

SEQ ID NO: 1936 - protein, 13 aa, artificial
  CDR-L1 of CDH19 65250.003
SGSRSNIGSNFVN

SEQ ID NO: 1937 - protein, 7 aa, artificial
  CDR-L2 of CDH19 65250.003
TNNQRPS

SEQ ID NO: 1938 - protein, 11 aa, artificial
  CDR-L3 of CDH19 65250.003
AVYDDSLNGWV

SEQ ID NO: 1939 - DNA, 360 bp, artificial; identical to SEQ ID NO: 1106
  VH of CDH19 65250.003

SEQ ID NO: 1940 - protein, 120 aa, artificial; identical to SEQ ID NO: 372
  VH of CDH19 65250.003

SEQ ID NO: 1941 - DNA, 333 bp, artificial
  VL of CDH19 65250.003
cagtccgtgctgacccagcctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtacgacgactccctgaacggctgggtgttcggcggaggcaccaagctgaccgtgctgtcc

SEQ ID NO: 1942 - protein, 111 aa, artificial
  VL of CDH19 65250.003
QSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLS

SEQ ID NO: 1943 - DNA, 738 bp, artificial
  VH-VL of CDH19 65250.003
caggtgcagctggtgcagtctggcgccgaagtgaagaaacctggcgcctccgtgaaggtgtcctgcaaggcctcccggtacaccttcaccagctactacatgtcctgggtccgacaggccccaggccagggcctggaatggatgggcatcatccacccctctggcggcgacaccacctacgcccagaaattccagggcagagtgaccatgaccggcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagcggaggcggaggatctggtggcggtggttctggcggcggaggctcccagtccgtgctgacccagcctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtacgacgactccctgaacggctgggtgttcggcggaggcaccaagctgaccgtgctgtcc

SEQ ID NO: 1944 - protein, 246 aa, artificial
  VH-VL of CDH19 65250.003
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDDSLNGWVFGGGTKLTVLS

SEQ ID NO: 1945 - protein, 506 aa, artificial; identical to SEQ ID NO: 1281
  CDH19 65250.003 x I2C

SEQ ID NO: 1946 - protein, 5 aa, artificial
  CDR-H1 of CDH19 65250.004
SYYMS

SEQ ID NO: 1947 - protein, 17 aa, artificial
  CDR-H2 of CDH19 65250.004
IIHPSGGDTTYAQKFQG

SEQ ID NO: 1948 - protein, 11 aa, artificial
  CDR-H3 of CDH19 65250.004
GGIKLWLHFDY

SEQ ID NO: 1949 - protein, 13 aa, artificial
  CDR-L1 of CDH19 65250.004
SGSRSNIGSNFVN

SEQ ID NO: 1950 - protein, 7 aa, artificial
  CDR-L2 of CDH19 65250.004
TNNQRPS

SEQ ID NO: 1951 - protein, 11 aa, artificial
  CDR-L3 of CDH19 65250.004
AVYDESLQGWV

SEQ ID NO: 1952 - DNA, 360 bp, artificial; identical to SEQ ID NO: 1106
  VH of CDH19 65250.004

SEQ ID NO: 1953 - protein, 120 aa, artificial; identical to SEQ ID NO: 372
  VH of CDH19 65250.004

SEQ ID NO: 1954 - DNA, 333 bp, artificial
  VL of CDH19 65250.004
cagtccgtgctgacccagcctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 1955 - protein, 111 aa, artificial
  VL of CDH19 65250.004
QSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLS

SEQ ID NO: 1956 - DNA, 738 bp, artificial
  VH-VL of CDH19 65250.004
caggtgcagctggtgcagtctggcgccgaagtgaagaaacctggcgcctccgtgaaggtgtcctgcaaggcctcccggtacaccttcaccagctactacatgtcctgggtccgacaggccccaggccagggcctggaatggatgggcatcatccacccctctggcggcgacaccacctacgcccagaaattccagggcagagtgaccatgaccggcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagcggaggcggaggatctggtggcggtggttctggcggcggaggctcccagtccgtgctgacccagcctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 1957 - protein, 246 aa, artificial
  VH-VL of CDH19 65250.004
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLS

SEQ ID NO: 1958 - protein, 506 aa, artificial
  CDH19 65250.004 x I2C
QVQLVQSGAEVKKPGASVKVSCKASRYTFTSYYMSWVRQAPGQGLEWMGIIHPSGGDTTYAQKFQGRVTMTGDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1959 - protein, 5 aa, artificial
  CDR-H1 of CDH19 65250.005
SYYMS

SEQ ID NO: 1960 - protein, 17 aa, artificial
  CDR-H2 of CDH19 65250.005
IIHPSGGDTTYAQKFQG

SEQ ID NO: 1961 - protein, 11 aa, artificial
  CDR-H3 of CDH19 65250.005
GGIKLWLHFDY

SEQ ID NO: 1962 - protein, 13 aa, artificial
  CDR-L1 of CDH19 65250.005
SGSRSNIGSNFVN

SEQ ID NO: 1963 - protein, 7 aa, artificial
  CDR-L2 of CDH19 65250.005
TNNQRPS

SEQ ID NO: 1964 - protein, 11 aa, artificial
  CDR-L3 of CDH19 65250.005
AVYDESLQGWV

SEQ ID NO: 1965 - DNA, 360 bp, artificial
  VH of CDH19 65250.005
caggtgcagctggtgcagtctggcgccgaagtgaagaaacctggcgcctccgtgaaggtgtcctgcaaggcctccgggtacaccttcaccagctactacatgtcctgggtccgacaggccccaggccagggcctggaatggatgggcatcatccacccctctggcggcgacaccacctacgcccagaaattccagggcagagtgaccatgacccgcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagc

SEQ ID NO: 1966 - protein, 120 aa, artificial; identical to SEQ ID NO: 524
  VH of CDH19 65250.005

SEQ ID NO: 1967 - DNA, 333 bp, artificial; identical to SEQ ID NO: 1954
  VL of CDH19 65250.005

SEQ ID NO: 1968 - protein, 111 aa, artificial; identical to SEQ ID NO: 1955
  VL of CDH19 65250.005

SEQ ID NO: 1969 - DNA, 738 bp, artificial
  VH-VL of CDH19 65250.005
caggtgcagctggtgcagtctggcgccgaagtgaagaaacctggcgcctccgtgaaggtgtcctgcaaggcctccgggtacaccttcaccagctactacatgtcctgggtccgacaggccccaggccagggcctggaatggatgggcatcatccacccctctggcggcgacaccacctacgcccagaaattccagggcagagtgaccatgacccgcgacacctccacctccaccgtgtatatggaactgtcctccctgcggagcgaggacaccgccgtgtactactgcgccagaggcggcatcaagctgtggctgcacttcgactactggggccagggcaccctggtcaccgtgtctagcggaggcggaggatctggtggcggtggttctggcggcggaggctcccagtccgtgctgacccagcctccttccgcctccggcacccctggccagcgcgtgaccatctcctgctccggctcccggtccaacatcggctccaacttcgtgaactggtatcagcagctgcccggcaccgcccccaagctgctgatctacaccaacaaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 1970 - protein, 246 aa, artificial
  VH-VL of CDH19 65250.005
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLS

SEQ ID NO: 1971 - protein, 506 aa, artificial
  CDH19 65250.005 x I2C
QVQLVQSGAEVKKPGASVKVSCKASGYTFTSYYMSWVRQAPGQGLEWMGIIHPSGGDTTYAQKFQGRVTMTRDTSTSTVYMELSSLRSEDTAVYYCARGGIKLWLHFDYWGQGTLVTVSSGGGGSGGGGSGGGGSQSVLTQPPSASGTPGQRVTISCSGSRSNIGSNFVNWYQQLPGTAPKLLIYTNNQRPSGVPDRFSGSKSGTSASLAISGLQSEDEADYYCAVYDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1972 - protein, 5 aa, artificial
  CDR-H1 of CDH19 65251.002
NYYMS

SEQ ID NO: 1973 - protein, 17 aa, artificial
  CDR-H2 of CDH19 65251.002
IINPSGGDSTYAQKFQG

SEQ ID NO: 1974 - protein, 11 aa, artificial
  CDR-H3 of CDH19 65251.002
GGIQLWLHFDY

SEQ ID NO: 1975 - protein, 13 aa, artificial
  CDR-L1 of CDH19 65251.002
SGSRSNIGSNFVN

SEQ ID NO: 1976 - protein, 7 aa, artificial
  CDR-L2 of CDH19 65251.002
TNYQRPS

SEQ ID NO: 1977 - protein, 11 aa, artificial
  CDR-L3 of CDH19 65251.002
AVWDESLNGWV

SEQ ID NO: 1978 - DNA, 360 bp, artificial; identical to SEQ ID NO: 1119
  VH of CDH19 65251.002

SEQ ID NO: 1979 - protein, 120 aa, artificial; identical to SEQ ID NO: 344
  VH of CDH19 65251.002

SEQ ID NO: 1980 - DNA, 333 bp, artificial
  VL of CDH19 65251.002
cagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgaacggctgggtgttcggcggaggcaccaagctgaccgtgctgtcc

SEQ ID NO: 1981 - protein, 111 aa, artificial
  VL of CDH19 65251.002
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLS

SEQ ID NO: 1982 - DNA, 738 bp, artificial
  VH-VL of CDH19 65251.002
caggtgcagctggtgcagtctggcgccgaagtgaagaaacctggcgcctccgtgaaggtgtcctgcaaggcctcccggtacaccttcaccaactactacatgtcctgggtccgacaggccccaggccagggcctggaatggatgggcatcatcaacccctctggcggcgactccacctacgcccagaagttccagggccggctgaccatgaccggcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgaacggctgggtgttcggcggaggcaccaagctgaccgtgctgtcc

SEQ ID NO: 1983 - protein, 246 aa, artificial
  VH-VL of CDH19 65251.002
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLS

SEQ ID NO: 1984 - protein, 506 aa, artificial
  CDH19 65251.002 x I2C
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1985 - protein, 5 aa, artificial
  CDR-H1 of CDH19 65251.003
NYYMS

SEQ ID NO: 1986 - protein, 17 aa, artificial
  CDR-H2 of CDH19 65251.003
IINPSGGDSTYAQKFQG

SEQ ID NO: 1987 - protein, 11 aa, artificial
  CDR-H3 of CDH19 65251.003
GGIQLWLHFDY

SEQ ID NO: 1988 - protein, 13 aa, artificial
  CDR-L1 of CDH19 65251.003
SGSRSNIGSNFVN

SEQ ID NO: 1989 - protein, 7 aa, artificial
  CDR-L2 of CDH19 65251.003
TNYQRPS

SEQ ID NO: 1990 - protein, 11 aa, artificial
  CDR-L3 of CDH19 65251.003
AVWDESLQGWV

SEQ ID NO: 1991 - DNA, 360 bp, artificial; identical to SEQ ID NO: 1119
  VH of CDH19 65251.003

SEQ ID NO: 1992 - protein, 120 aa, artificial; identical to SEQ ID NO: 344
  VH of CDH19 65251.003

SEQ ID NO: 1993 - DNA, 333 bp, artificial
  VL of CDH19 65251.003
cagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgcagggctgggtgttcggcggaggcaccaagctgaccgtgctgtcc

SEQ ID NO: 1994 - protein, 111 aa, artificial
  VL of CDH19 65251.003
QSVLTQPPSASGTPGQKVTISCSGSRSNIGSNFVNWYQQLPGTAPKLLIYTNYQRPSGVPDRFSGSKSGTSASLAISGLQSEDEADYYCAVWDESLQGWVFGGGTKLTVLS

SEQ ID NO: 1995 - DNA, 738 bp, artificial
  VH-VL of CDH19 65251.003
caggtgcagctggtgcagtctggcgccgaagtgaagaaacctggcgcctccgtgaaggtgtcctgcaaggcctcccggtacaccttcaccaactactacatgtcctgggtccgacaggccccaggccagggcctggaatggatgggcatcatcaacccctctggcggcgactccacctacgcccagaagttccagggccggctgaccatgaccggcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgcagggctgggtgttcggcggaggcaccaagctgaccgtgctgtcc

SEQ ID NO: 1996 - protein, 246 aa, artificial
  VH-VL of CDH19 65251.003
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLQGWVFGGGTKLTVLS

SEQ ID NO: 1997 - protein, 506 aa, artificial
  CDH19 65251.003 x I2C
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 1998 - protein, 5 aa, artificial
  CDR-H1 of CDH19 65251.004
NYYMS

SEQ ID NO: 1999 - protein, 17 aa, artificial
  CDR-H2 of CDH19 65251.004
IINPSGGDSTYAQKFQG

SEQ ID NO: 2000 - protein, 11 aa, artificial
  CDR-H3 of CDH19 65251.004
GGIQLWLHFDY

SEQ ID NO: 2001 - protein, 13 aa, artificial
  CDR-L1 of CDH19 65251.004
SGSRSNIGSNFVN

SEQ ID NO: 2002 - protein, 7 aa, artificial
  CDR-L2 of CDH19 65251.004
TNYQRPS

SEQ ID NO: 2003 - protein, 11 aa, artificial
  CDR-L3 of CDH19 65251.004
AVYDESLQGWV

SEQ ID NO: 2004 - DNA, 360 bp, artificial; identical to SEQ ID NO: 1119
  VH of CDH19 65251.004

SEQ ID NO: 2005 - protein, 120 aa, artificial; identical to SEQ ID NO: 344
  VH of CDH19 65251.004

SEQ ID NO: 2006 - DNA, 333 bp, artificial
  VL of CDH19 65251.004
cagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 2007 - protein, 111 aa, artificial
  VL of CDH19 65251.004
QSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLS

SEQ ID NO: 2008 - DNA, 738 bp, artificial
  VH-VL of CDH19 65251.004
caggtgcagctggtgcagtctggcgccgaagtgaagaaacctggcgcctccgtgaaggtgtcctgcaaggcctcccggtacaccttcaccaactactacatgtcctgggtccgacaggccccaggccagggcctggaatggatgggcatcatcaacccctctggcggcgactccacctacgcccagaagttccagggccggctgaccatgaccggcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 2009 - protein, 246 aa, artificial
  VH-VL of CDH19 65251.004
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLS

SEQ ID NO: 2010 - protein, 506 aa, artificial
  CDH19 65251.004 x I2C
QVQLVQSGAEVKKPGASVKVSCKASRYTFTNYYMSWVRQAPGQGLEWMGIINPSGGDSTYAQKFQGRLTMTGDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2011 - protein, 5 aa, artificial
  CDR-H1 of CDH19 65251.005
NYYMS

SEQ ID NO: 2012 - protein, 17 aa, artificial
  CDR-H2 of CDH19 65251.005
IINPSGGDSTYAQKFQG

SEQ ID NO: 2013 - protein, 11 aa, artificial
  CDR-H3 of CDH19 65251.005
GGIQLWLHFDY

SEQ ID NO: 2014 - protein, 13 aa, artificial
  CDR-L1 of CDH19 65251.005
SGSRSNIGSNFVN

SEQ ID NO: 2015 - protein, 7 aa, artificial
  CDR-L2 of CDH19 65251.005
TNYQRPS

SEQ ID NO: 2016 - protein, 11 aa, artificial
  CDR-L3 of CDH19 65251.005
AVWDDSLNGWV

SEQ ID NO: 2017 - DNA, 360 bp, artificial
  VH of CDH19 65251.005
caggtgcagctggtgcagtctggcgccgaagtgaagaaacctggcgcctccgtgaaggtgtcctgcaaggcctccgggtacaccttcaccaactactacatgtcctgggtccgacaggccccaggccagggcctggaatggatgggcatcatcaacccctctggcggcgactccacctacgcccagaagttccagggccggctgaccatgacccgcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagc

SEQ ID NO: 2018 - protein, 120 aa, artificial
  VH of CDH19 65251.005
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSS

SEQ ID NO: 2019 - DNA, 333 bp, artificial
  VL of CDH19 65251.005
cagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctgtcc

SEQ ID NO: 2020 - protein, 111 aa, artificial
  VL of CDH19 65251.005
QSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLS

SEQ ID NO: 2021 - DNA, 738 bp, artificial
  VH-VL of CDH19 65251.005
caggtgcagctggtgcagtctggcgccgaagtgaagaaacctggcgcctccgtgaaggtgtcctgcaaggcctccgggtacaccttcaccaactactacatgtcctgggtccgacaggccccaggccagggcctggaatggatgggcatcatcaacccctctggcggcgactccacctacgcccagaagttccagggccggctgaccatgacccgcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgactccctgaacggctgggtgttcggcggaggcaccaagctgaccgtgctgtcc

SEQ ID NO: 2022 - protein, 246 aa, artificial
  VH-VL of CDH19 65251.005
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLS

SEQ ID NO: 2023 - protein, 506 aa, artificial
  CDH19 65251.005 x I2C
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDDSLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2024 - protein, 5 aa, artificial
  CDR-H1 of CDH19 65251.006
NYYMS

SEQ ID NO: 2025 - protein, 17 aa, artificial
  CDR-H2 of CDH19 65251.006
IINPSGGDSTYAQKFQG

SEQ ID NO: 2026 - protein, 11 aa, artificial
  CDR-H3 of CDH19 65251.006
GGIQLWLHFDY

SEQ ID NO: 2027 - protein, 13 aa, artificial
  CDR-L1 of CDH19 65251.006
SGSRSNIGSNFVN

SEQ ID NO: 2028 - protein, 7 aa, artificial
  CDR-L2 of CDH19 65251.006
TNYQRPS

SEQ ID NO: 2029 - protein, 11 aa, artificial
  CDR-L3 of CDH19 65251.006
AVWDESLNGWV

SEQ ID NO: 2030 - DNA, 360 bp, artificial; identical to SEQ ID NO: 2017
  VH of CDH19 65251.006

SEQ ID NO: 2031 - protein, 120 aa, artificial; identical to SEQ ID NO: 2018
  VH of CDH19 65251.006

SEQ ID NO: 2032 - DNA, 333 bp, artificial; identical to SEQ ID NO: 1980
  VL of CDH19 65251.006

SEQ ID NO: 2033 - protein, 111 aa, artificial; identical to SEQ ID NO: 1981
  VL of CDH19 65251.006

SEQ ID NO: 2034 - DNA, 738 bp, artificial
  VH-VL of CDH19 65251.006
caggtgcagctggtgcagtctggcgccgaagtgaagaaacctggcgcctccgtgaaggtgtcctgcaaggcctccgggtacaccttcaccaactactacatgtcctgggtccgacaggccccaggccagggcctggaatggatgggcatcatcaacccctctggcggcgactccacctacgcccagaagttccagggccggctgaccatgacccgcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgaacggctgggtgttcggcggaggcaccaagctgaccgtgctgtcc

SEQ ID NO: 2035 - protein, 246 aa, artificial
  VH-VL of CDH19 65251.006
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLS

SEQ ID NO: 2036 - protein, 506 aa, artificial
  CDH19 65251.006 x I2C
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLNGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2037 - protein, 5 aa, artificial
  CDR-H1 of CDH19 65251.007
NYYMS

SEQ ID NO: 2038 - protein, 17 aa, artificial
  CDR-H2 of CDH19 65251.007
IINPSGGDSTYAQKFQG

SEQ ID NO: 2039 - protein, 11 aa, artificial
  CDR-H3 of CDH19 65251.007
GGIQLWLHFDY

SEQ ID NO: 2040 - protein, 13 aa, artificial
  CDR-L1 of CDH19 65251.007
SGSRSNIGSNFVN

SEQ ID NO: 2041 - protein, 7 aa, artificial
  CDR-L2 of CDH19 65251.007
TNYQRPS

SEQ ID NO: 2042 - protein, 11 aa, artificial
  CDR-L3 of CDH19 65251.007
AVWDESLQGWV

SEQ ID NO: 2043 - DNA, 360 bp, artificial; identical to SEQ ID NO: 2017
  VH of CDH19 65251.007

SEQ ID NO: 2044 - protein, 120 aa, artificial; identical to SEQ ID NO: 2018
  VH of CDH19 65251.007

SEQ ID NO: 2045 - DNA, 333 bp, artificial; identical to SEQ ID NO: 1993
  VL of CDH19 65251.007

SEQ ID NO: 2046 - protein, 111 aa, artificial; identical to SEQ ID NO: 1994
  VL of CDH19 65251.007

SEQ ID NO: 2047 - DNA, 738 bp, artificial
  VH-VL of CDH19 65251.007
caggtgcagctggtgcagtctggcgccgaagtgaagaaacctggcgcctccgtgaaggtgtcctgcaaggcctccgggtacaccttcaccaactactacatgtcctgggtccgacaggccccaggccagggcctggaatggatgggcatcatcaacccctctggcggcgactccacctacgcccagaagttccagggccggctgaccatgacccgcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtgggacgagtccctgcagggctgggtgttcggcggaggcaccaagctgaccgtgctgtcc

SEQ ID NO: 2048 - protein, 246 aa, artificial
  VH-VL of CDH19 65251.007
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLQGWVFGGGTKLTVLS

SEQ ID NO: 2049 - protein, 506 aa, artificial
  CDH19 65251.007 x I2C
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVWDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2050 - protein, 5 aa, artificial
  CDR-H1 of CDH19 65251.008
NYYMS

SEQ ID NO: 2051 - protein, 17 aa, artificial
  CDR-H2 of CDH19 65251.008
IINPSGGDSTYAQKFQG

SEQ ID NO: 2052 - protein, 11 aa, artificial
  CDR-H3 of CDH19 65251.008
GGIQLWLHFDY

SEQ ID NO: 2053 - protein, 13 aa, artificial
  CDR-L1 of CDH19 65251.008
SGSRSNIGSNFVN

SEQ ID NO: 2054 - protein, 7 aa, artificial
  CDR-L2 of CDH19 65251.008
TNYQRPS

SEQ ID NO: 2055 - protein, 11 aa, artificial
  CDR-L3 of CDH19 65251.008
AVYDESLQGWV

SEQ ID NO: 2056 - DNA, 360 bp, artificial; identical to SEQ ID NO: 2017
  VH of CDH19 65251.008

SEQ ID NO: 2057 - protein, 120 aa, artificial; identical to SEQ ID NO: 2018
  VH of CDH19 65251.008

SEQ ID NO: 2058 - DNA, 333 bp, artificial; identical to SEQ ID NO: 2006
  VL of CDH19 65251.008

SEQ ID NO: 2059 - protein, 111 aa, artificial; identical to SEQ ID NO: 2007
  VL of CDH19 65251.008

SEQ ID NO: 2060 - DNA, 738 bp, artificial
  VH-VL of CDH19 65251.008
caggtgcagctggtgcagtctggcgccgaagtgaagaaacctggcgcctccgtgaaggtgtcctgcaaggcctccgggtacaccttcaccaactactacatgtcctgggtccgacaggccccaggccagggcctggaatggatgggcatcatcaacccctctggcggcgactccacctacgcccagaagttccagggccggctgaccatgacccgcgacacctccacctccaccgtgtatatggaactgtcctccctgcggagcgaggacaccgccgtgtactactgcgccagaggcggcatccagctgtggctgcacttcgactactggggccagggcaccctggtcaccgtgtctagcggaggcggaggatctggtggcggtggttctggcggcggaggctcccagtctgtgctgacccagcccccttccgcctctggcacccctggccagaaagtgaccatctcctgctccggctcccggtccaacatcggctccaacttcgtgaactggtatcagcagctgcccggcaccgcccccaagctgctgatctacaccaactaccagcggccctccggcgtgcccgaccggttctctggctccaagtctggcacctccgcctccctggccatctccggcctgcagtctgaggacgaggccgactactactgtgccgtgtacgacgagtccctgcagggctgggtgttcggcggaggcaccaagctgaccgtgctgtcc

SEQ ID NO: 2061 - protein, 246 aa, artificial
  VH-VL of CDH19 65251.008
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLS

SEQ ID NO: 2062 - protein, 506 aa, artificial
  CDH19 65251.008 x I2C
QVQLVQSGAEVKKPGASVKVSCKASGYTFTNYYMSWVRQAPGQGLEWMGIINPSGGDSTYAQKFQGRLTMTRDTSTSTVYMELSSLRSEDTAVYYCARGGIQLWLHFDYWGQGTLVTVSSGGGGSGGGGSGGGGSQSVLTQPPSASGTPGQKVTISCSGSRSNIGSNFVNWYQQLPGTAPKLLIYTNYQRPSGVPDRFSGSKSGTSASLAISGLQSEDEADYYCAVYDESLQGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2063 - protein, 5 aa, artificial
  CDR-H1 of CDH19 65252.005
SYDMD

SEQ ID NO: 2064 - protein, 17 aa, artificial
  CDR-H2 of CDH19 65252.005
VIWYDGSNKYYADSVRG

SEQ ID NO: 2065 - protein, 10 aa, artificial
  CDR-H3 of CDH19 65252.005
ETGEGWYFDL

SEQ ID NO: 2066 - protein, 12 aa, artificial
  CDR-L1 of CDH19 65252.005
RASQSVSSSYLA

SEQ ID NO: 2067 - protein, 7 aa, artificial
  CDR-L2 of CDH19 65252.005
GASSRAT

SEQ ID NO: 2068 - protein, 8 aa, artificial
  CDR-L3 of CDH19 65252.005
QQYGSSWT

SEQ ID NO: 2069 - DNA, 357 bp, artificial
  VH of CDH19 65252.005
caggtgcagctggtggaatccggcggaggcgtggtgcagcctggcgggtccctgagactgtcttgtgccgcctccggcttcagcttctcctcctacgacatggactgggtccgacagacccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagc

SEQ ID NO: 2070 - protein, 119 aa, artificial
  VH of CDH19 65252.005
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSS

SEQ ID NO: 2071 - DNA, 324 bp, artificial
  VL of CDH19 65252.005
gagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2072 - protein, 108 aa, artificial
  VL of CDH19 65252.005
EIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKS

SEQ ID NO: 2073 - DNA, 726 bp, artificial
  VH-VL of CDH19 65252.005
caggtgcagctggtggaatccggcggaggcgtggtgcagcctggcgggtccctgagactgtcttgtgccgcctccggcttcagcttctcctcctacgacatggactgggtccgacagacccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2074 - protein, 242 aa, artificial
  VH-VL of CDH19 65252.005
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKS

SEQ ID NO: 2075 - protein, 502 aa, artificial
  CDH19 65252.005 x I2C
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2076 - protein, 5 aa, artificial
  CDR-H1 of CDH19 65252.006
SYDMD

SEQ ID NO: 2077 - protein, 17 aa, artificial
  CDR-H2 of CDH19 65252.006
VIWYDGSNKYYADSVRG

SEQ ID NO: 2078 - protein, 10 aa, artificial
  CDR-H3 of CDH19 65252.006
ETGEGWYFDL

SEQ ID NO: 2079 - protein, 12 aa, artificial
  CDR-L1 of CDH19 65252.006
RASQSVSSSYLA

SEQ ID NO: 2080 - protein, 7 aa, artificial
  CDR-L2 of CDH19 65252.006
GASSRAT

SEQ ID NO: 2081 - protein, 8 aa, artificial
  CDR-L3 of CDH19 65252.006
QQYGSSWT

SEQ ID NO: 2082 - DNA, 357 bp, artificial
  VH of CDH19 65252.006
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagc

SEQ ID NO: 2083 - protein, 119 aa, artificial; identical to SEQ ID NO: 471
  VH of CDH19 65252.006

SEQ ID NO: 2084 - DNA, 324 bp, artificial; identical to SEQ ID NO: 2071
  VL of CDH19 65252.006

SEQ ID NO: 2085 - protein, 108 aa, artificial; identical to SEQ ID NO: 2072
  VL of CDH19 65252.006

SEQ ID NO: 2086 - DNA, 726 bp, artificial
  VH-VL of CDH19 65252.006
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2087 - protein, 242 aa, artificial
  VH-VL of CDH19 65252.006
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKS

SEQ ID NO: 2088 - protein, 502 aa, artificial
  CDH19 65252.006 x I2C
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2089 - protein, 5 aa, artificial
  CDR-H1 of CDH19 65252.007
SYDMD

SEQ ID NO: 2090 - protein, 17 aa, artificial
  CDR-H2 of CDH19 65252.007
VIWYDGSNKYYADSVRG

SEQ ID NO: 2091 - protein, 10 aa, artificial
  CDR-H3 of CDH19 65252.007
ETGEGWYFDL

SEQ ID NO: 2092 - protein, 12 aa, artificial
  CDR-L1 of CDH19 65252.007
RASQSVSSSYLA

SEQ ID NO: 2093 - protein, 7 aa, artificial
  CDR-L2 of CDH19 65252.007
GASSRAT

SEQ ID NO: 2094 - protein, 8 aa, artificial
  CDR-L3 of CDH19 65252.007
QQYGSSWT

SEQ ID NO: 2095 - DNA, 357 bp, artificial
  VH of CDH19 65252.007
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagc

SEQ ID NO: 2096 - protein, 119 aa, artificial; identical to SEQ ID NO: 472
  VH of CDH19 65252.007

SEQ ID NO: 2097 - DNA, 324 bp, artificial; identical to SEQ ID NO: 2071
  VL of CDH19 65252.007

SEQ ID NO: 2098 - protein, 108 aa, artificial; identical to SEQ ID NO: 2072
  VL of CDH19 65252.007

SEQ ID NO: 2099 - DNA, 726 bp, artificial
  VH-VL of CDH19 65252.007
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2100 - protein, 242 aa, artificial
  VH-VL of CDH19 65252.007
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKS

SEQ ID NO: 2101 - protein, 502 aa, artificial
  CDH19 65252.007 x I2C
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2102 - protein, 5 aa, artificial
  CDR-H1 of CDH19 65252.008
SYDMD

SEQ ID NO: 2103 - protein, 17 aa, artificial
  CDR-H2 of CDH19 65252.008
VIWYEGSNKYYAESVRG

SEQ ID NO: 2104 - protein, 10 aa, artificial
  CDR-H3 of CDH19 65252.008
ETGEGWYFDL

SEQ ID NO: 2105 - protein, 12 aa, artificial
  CDR-L1 of CDH19 65252.008
RASQSVSSSYLA

SEQ ID NO: 2106 - protein, 7 aa, artificial
  CDR-L2 of CDH19 65252.008
GASSRAT

SEQ ID NO: 2107 - protein, 8 aa, artificial
  CDR-L3 of CDH19 65252.008
QQYGSSWT

SEQ ID NO: 2108 - DNA, 357 bp, artificial
  VH of CDH19 65252.008
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgagggctccaacaagtactacgccgagtccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagc

SEQ ID NO: 2109 - protein, 119 aa, artificial; identical to SEQ ID NO: 473
  VH of CDH19 65252.008

SEQ ID NO: 2110 - DNA, 324 bp, artificial; identical to SEQ ID NO: 2071
  VL of CDH19 65252.008

SEQ ID NO: 2111 - protein, 108 aa, artificial; identical to SEQ ID NO: 2072
  VL of CDH19 65252.008

SEQ ID NO: 2112 - DNA, 726 bp, artificial
  VH-VL of CDH19 65252.008
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgagggctccaacaagtactacgccgagtccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaagcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2113 - protein, 242 aa, artificial
  VH-VL of CDH19 65252.008
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKS

SEQ ID NO: 2114 - protein, 502 aa, artificial
  CDH19 65252.008 x I2C
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQKPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2115 - protein, 5 aa, artificial
  CDR-H1 of CDH19 65252.009
SYDMD

SEQ ID NO: 2116 - protein, 17 aa, artificial
  CDR-H2 of CDH19 65252.009
VIWYDGSNKYYADSVRG

SEQ ID NO: 2117 - protein, 10 aa, artificial
  CDR-H3 of CDH19 65252.009
ETGEGWYFDL

SEQ ID NO: 2118 - protein, 12 aa, artificial
  CDR-L1 of CDH19 65252.009
RASQSVSSSYLA

SEQ ID NO: 2119 - protein, 7 aa, artificial
  CDR-L2 of CDH19 65252.009
GASSRAT

SEQ ID NO: 2120 - protein, 8 aa, artificial
  CDR-L3 of CDH19 65252.009
QQYGSSWT

SEQ ID NO: 2121 - DNA, 357 bp, artificial; identical to SEQ ID NO: 2069
  VH of CDH19 65252.009

SEQ ID NO: 2122 - protein, 119 aa, artificial; identical to SEQ ID NO: 2070
  VH of CDH19 65252.009

SEQ ID NO: 2123 - DNA, 324 bp, artificial
  VL of CDH19 65252.009
gagatcgtgctgacccagtcccctggcaccctgtccctgagccctggcgagagagccaccctgtcctgcagagcctcccagtccgtgtcctcctcctacctggcctggtatcagcagaggcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2124 - protein, 108 aa, artificial
  VL of CDH19 65252.009
EIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKS

SEQ ID NO: 2125 - DNA, 726 bp, artificial
  VH-VL of CDH19 65252.009
caggtgcagctggtggaatccggcggaggcgtggtgcagcctggcgggtccctgagactgtcttgtgccgcctccggcttcagcttctcctcctacgacatggactgggtccgacagacccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaggcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2126 - protein, 242 aa, artificial
  VH-VL of CDH19 65252.009
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKS

SEQ ID NO: 2127 - protein, 502 aa, artificial
  CDH19 65252.009 x I2C
QVQLVESGGGVVQPGGSLRLSCAASGFSFSSYDMDWVRQTPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2128 - protein, 5 aa, artificial
  CDR-H1 of CDH19 65252.010
SYDMD

SEQ ID NO: 2129 - protein, 17 aa, artificial
  CDR-H2 of CDH19 65252.010
VIWYDGSNKYYADSVRG

SEQ ID NO: 2130 - protein, 10 aa, artificial
  CDR-H3 of CDH19 65252.010
ETGEGWYFDL

SEQ ID NO: 2131 - protein, 12 aa, artificial
  CDR-L1 of CDH19 65252.010
RASQSVSSSYLA

SEQ ID NO: 2132 - protein, 7 aa, artificial
  CDR-L2 of CDH19 65252.010
GASSRAT

SEQ ID NO: 2133 - protein, 8 aa, artificial
  CDR-L3 of CDH19 65252.010
QQYGSSWT

SEQ ID NO: 2134 - DNA, 357 bp, artificial; identical to SEQ ID NO: 2082
  VH of CDH19 65252.010

SEQ ID NO: 2135 - protein, 119 aa, artificial; identical to SEQ ID NO: 471
  VH of CDH19 65252.010

SEQ ID NO: 2136 - DNA, 324 bp, artificial; identical to SEQ ID NO: 2123
  VL of CDH19 65252.010

SEQ ID NO: 2137 - protein, 108 aa, artificial; identical to SEQ ID NO: 2124
  VL of CDH19 65252.010

SEQ ID NO: 2138 - DNA, 726 bp, artificial
  VH-VL of CDH19 65252.010
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggcagaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaggcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2139 - protein, 242 aa, artificial
  VH-VL of CDH19 65252.010
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKS

SEQ ID NO: 2140 - protein, 502 aa, artificial
  CDH19 65252.010 x I2C
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGRGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2141 - protein, 5 aa, artificial
  CDR-H1 of CDH19 65252.011
SYDMD

SEQ ID NO: 2142 - protein, 17 aa, artificial
  CDR-H2 of CDH19 65252.011
VIWYDGSNKYYADSVRG

SEQ ID NO: 2143 - protein, 10 aa, artificial
  VIWYDGSNKYYADSVRG
ETGEGWYFDL

SEQ ID NO: 2144 - protein, 12 aa, artificial
  CDR-L1 of CDH19 65252.011
RASQSVSSSYLA

SEQ ID NO: 2145 - protein, 7 aa, artificial
  CDR-L2 of CDH19 65252.011
GASSRAT

SEQ ID NO: 2146 - protein, 8 aa, artificial
  CDR-L3 of CDH19 65252.011
QQYGSSWT

SEQ ID NO: 2147 - DNA, 357 bp, artificial; identical to SEQ ID NO: 2095
  VH of CDH19 65252.011

SEQ ID NO: 2148 - protein, 119 aa, artificial; identical to SEQ ID NO: 472
  VH of CDH19 65252.011

SEQ ID NO: 2149 - DNA, 324 bp, artificial; identical to SEQ ID NO: 2123
  VL of CDH19 65252.011

SEQ ID NO: 2150 - protein, 108 aa, artificial; identical to SEQ ID NO: 2124
  VL of CDH19 65252.011

SEQ ID NO: 2151 - DNA, 726 bp, artificial
  VH-VL of CDH19 65252.011
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgacggctccaacaagtactacgccgactccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaggcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2152 - protein, 242 aa, artificial
  VH-VL of CDH19 65252.011
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKS

SEQ ID NO: 2153 - protein, 502 aa, artificial
  CDH19 65252.011 x I2C
QVQLVESGGGVVQPGGSLRLSCAASGFSFSSYDMDWVRQAPGKGLEWVAVIWYDGSNKYYADSVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2154 - protein, 5 aa, artificial
  CDR-H1 of CDH19 65252.012
SYDMD

SEQ ID NO: 2155 - protein, 17 aa, artificial
  CDR-H2 of CDH19 65252.012
VIWYEGSNKYYAESVRG

SEQ ID NO: 2156 - protein, 10 aa, artificial
  CDR-H3 of CDH19 65252.012
ETGEGWYFDL

SEQ ID NO: 2157 - protein, 12 aa, artificial
  CDR-L1 of CDH19 65252.012
RASQSVSSSYLA

SEQ ID NO: 2158 - protein, 7 aa, artificial
  CDR-L2 of CDH19 65252.012
GASSRAT

SEQ ID NO: 2159 - protein, 8 aa, artificial
  CDR-L3 of CDH19 65252.012
QQYGSSWT

SEQ ID NO: 2160 - DNA, 357 bp, artificial; identical to SEQ ID NO: 2108
  VH of CDH19 65252.012

SEQ ID NO: 2161 - protein, 119 aa, artificial; identical to SEQ ID NO: 473
  VH of CDH19 65252.012

SEQ ID NO: 2162 - DNA, 324 bp, artificial; identical to SEQ ID NO: 2123
  VL of CDH19 65252.012

SEQ ID NO: 2163 - protein, 108 aa, artificial; identical to SEQ ID NO: 2124
  VL of CDH19 65252.012

SEQ ID NO: 2164 - DNA, 726 bp, artificial
  VH-VL of CDH19 65252.012
caggtgcagctggtggaatccggcggaggcgtggtgcagcctggcgggtccctgagactgtcttgtgccgcctccggcttcagcttctcctcctacgacatggactgggtccgacaggcccccggcaagggcctggaatgggtggccgtgatttggtacgagggctccaacaagtactacgccgagtccgtgcggggcagattcaccatctcccgggacaactccaagaacaccctgtttctgcagatgaactccctgcgggtggaagataccgccgtgtactactgcgccagagagacaggcgagggctggtacttcgacctgtggggccaaggcaccctggtcaccgtgtctagcggaggcggaggatctggtggcggtggttctggcggcggaggctccgagatcgtgctgacccagtcccctggcaccctgtccctgagccctggcgagagagccaccctgtcctgcagagcctcccagtccgtgtcctcctcctacctggcctggtatcagcagaggcccggccaggcccctcggctgctgatctacggcgcctcttccagagccaccggcatccctgaccggttctccggctctggctccggcaccgacttcaccctgaccatcagctcgctggaacccgaggacttcgctgtgtactattgccagcagtacggctcctcctggaccttcggccagggcaccaaggtggaaatcaagtcc

SEQ ID NO: 2165 - protein, 242 aa, artificial
  VH-VL of CDH19 65252.012
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKS

SEQ ID NO: 2166 - protein, 502 aa, artificial
  CDH19 65252.012 x I2C
QVQLVESGGGVVQPGGSLRLSCAASGFSFSSYDMDWVRQAPGKGLEWVAVIWYEGSNKYYAESVRGRFTISRDNSKNTLFLQMNSLRVEDTAVYYCARETGEGWYFDLWGQGTLVTVSSGGGGSGGGGSGGGGSEIVLTQSPGTLSLSPGERATLSCRASQSVSSSYLAWYQQRPGQAPRLLIYGASSRATGIPDRFSGSGSGTDFTLTISSLEPEDFAVYYCQQYGSSWTFGQGTKVEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2167 - protein, 5 aa, artificial
  CDR-H1 of CDH19 65253.003
SYSWS

SEQ ID NO: 2168 - protein, 16 aa, artificial
  CDR-H2 of CDH19 65253.003
YIYYSGSTNYNPSLKS

SEQ ID NO: 2169 - protein, 8 aa, artificial
  CDR-H3 of CDH19 65253.003
NWAFHFDY

SEQ ID NO: 2170 - protein, 14 aa, artificial
  CDR-L1 of CDH19 65253.003
TGSSSNIGTGYDVH

SEQ ID NO: 2171 - protein, 7 aa, artificial
  CDR-L2 of CDH19 65253.003
GNSNRPS

SEQ ID NO: 2172 - protein, 11 aa, artificial
  CDR-L3 of CDH19 65253.003
QSYESSLSGWV

SEQ ID NO: 2173 - DNA, 348 bp, artificial; identical to SEQ ID NO: 1171
  VH of CDH19 65253.003

SEQ ID NO: 2174 - protein, 116 aa, artificial; identical to SEQ ID NO: 364
  VH of CDH19 65253.003

SEQ ID NO: 2175 - DNA, 336 bp, artificial
  VL of CDH19 65253.003
cagtctgtgctgacccagcctccctctgtgtctggcgcccctggccagcgcgtgaccatttcctgcaccggctcctccagcaacatcggcaccggctacgacgtgcactggtatcagcagctgcccggcaccgcccccaagctgctgatctacggcaactccaaccggccctccggcgtgcccgaccggttctctggctccaagtctggcacctccgcctccctggctatcaccggcctgcaggctgaggacgaggccgactactactgccagtcctacgagtcctccctgtccggctgggtgttcggcggaggcaccaaactgaccgtgctgtcc

SEQ ID NO: 2176 - protein, 112 aa, artificial
  VL of CDH19 65253.003
QSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTKLTVLS

SEQ ID NO: 2177 - DNA, 729 bp, artificial
  VH-VL of CDH19 65253.003
caggtgcagctgcaggaatccggccctggcctggtcaagccctccgagacactgtccctgacctgcaccgtgtccggcggctccatctcctcctactcttggtcctggatccggcagccccctggcaagggcctggaatggatcggctacatctactactccggctccaccaactacaaccccagcctgaagtccagagtgaccatctccctggacacctccaagaaccagttctccctgaagctgtcctccgtgaccgccgctgacaccgccgtgtactactgcgcccggaactgggccttccacttcgactactggggccagggcaccctggtcaccgtgtctagcggaggcggaggatctggtggcggtggttctggcggcggaggctcccagtctgtgctgacccagcctccctctgtgtctggcgcccctggccagcgcgtgaccatttcctgcaccggctcctccagcaacatcggcaccggctacgacgtgcactggtatcagcagctgcccggcaccgcccccaagctgctgatctacggcaactccaaccggccctccggcgtgcccgaccggttctctggctccaagtctggcacctccgcctccctggctatcaccggcctgcaggctgaggacgaggccgactactactgccagtcctacgagtcctccctgtccggctgggtgttcggcggaggcaccaaactgaccgtgctgtcc

SEQ ID NO: 2178 - protein, 243 aa, artificial
  VH-VL of CDH19 65253.003
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTKLTVLS

SEQ ID NO: 2179 - protein, 503 aa, artificial
  CDH19 65253.003 x I2C
QVQLQESGPGLVKPSETLSLTCTVSGGSISSYSWSWIRQPPGKGLEWIGYIYYSGSTNYNPSLKSRVTISLDTSKNQFSLKLSSVTAADTAVYYCARNWAFHFDYWGQGTLVTVSSGGGGSGGGGSGGGGSQSVLTQPPSVSGAPGQRVTISCTGSSSNIGTGYDVHWYQQLPGTAPKLLIYGNSNRPSGVPDRFSGSKSGTSASLAITGLQAEDEADYYCQSYESSLSGWVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2180 - protein, 5 aa, artificial
  CDR-H1 of CDH19 65254.001
SYGMH

SEQ ID NO: 2181 - protein, 17 aa, artificial
  CDR-H2 of CDH19 65254.001
FIWYDGSNKYYADSVKD

SEQ ID NO: 2182 - protein, 16 aa, artificial
  CDR-H3 of CDH19 65254.001
RAGIIGTIGYYYGMDV

SEQ ID NO: 2183 - protein, 11 aa, artificial
  CDR-L1 of CDH19 65254.001
SGDRLGEKYTS

SEQ ID NO: 2184 - protein, 7 aa, artificial
  CDR-L2 of CDH19 65254.001
QDTKRPS

SEQ ID NO: 2185 - protein, 9 aa, artificial
  CDR-L3 of CDH19 65254.001
QAWDSSTVV

SEQ ID NO: 2186 - DNA, 375 bp, artificial; identical to SEQ ID NO: 976
  VH of CDH19 65254.001

SEQ ID NO: 2187 - protein, 125 aa, artificial; identical to SEQ ID NO: 384
  VH of CDH19 65254.001

SEQ ID NO: 2188 - DNA, 321 bp, artificial
  VL of CDH19 65254.001
tcttacgagctgacccagcccccctccgtgtccgtgtctcctggccagaccgcctccatcacctgttctggcgaccggctgggcgagaagtacaccagttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 2189 - protein, 107 aa, artificial
  VL of CDH19 65254.001
SYELTQPPSVSVSPGQTASITCSGDRLGEKYTSWYQQRPGQSPLLVIYQDTKRPSGIPERFSGSNSGNTATLTISGTQAMDEADYYCQAWDSSTVVFGGGTKLTVLS

SEQ ID NO: 2190 - DNA, 741 bp, artificial
  VH-VL of CDH19 65254.001
caggtgcagctggtggaatccggcggaggcgtggtgcagcctggccggtccctgagactgtcttgcgccgcctccggcttcaccttctccagctacggcatgcactgggtccgacaggcccctggcaagggcctggaatgggtggccttcatttggtacgacggctccaacaagtactacgccgactccgtgaaggaccggttcaccatctcccgggacaactccaagaacaccctgtacctgcagatgaagtccctgcgggccgaggacaccgccgtgtactactgtgccagaagggccggcatcatcggcaccatcggctactactacggcatggacgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaagtacaccagttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 2191 - protein, 247 aa, artificial
  VH-VL of CDH19 65254.001
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWDSSTVVFGGGTKLTVLS

SEQ ID NO: 2192 - protein, 507 aa, artificial
  CDH19 65254.001 x I2C
QVQLVESGGGVVQPGRSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2193 - protein, 5 aa, artificial
  CDR-H1 of CDH19 65254.003
SYGMH

SEQ ID NO: 2194 - protein, 17 aa, artificial
  CDR-H2 of CDH19 65254.003
FIWYDGSNKYYADSVKD

SEQ ID NO: 2195 - protein, 16 aa, artificial
  CDR-H3 of CDH19 65254.003
RAGIIGTIGYYYGMDV

SEQ ID NO: 2196 - protein, 11 aa, artificial
  CDR-L1 of CDH19 65254.003
SGDRLGEKYTS

SEQ ID NO: 2197 - protein, 7 aa, artificial
  CDR-L2 of CDH19 65254.003
QDTKRPS

SEQ ID NO: 2198 - protein, 9 aa, artificial
  CDR-L3 of CDH19 65254.003
QAWDSSTVV

SEQ ID NO: 2199 - DNA, 375 bp, artificial
  VH of CDH19 65254.003
caggtgcagctggtggaatccggcggaggcgtggtgcagcctggcgggtccctgagactgtcttgcgccgcctccggcttcaccttctccagctacggcatgcactgggtccgacaggcccctggcaagggcctggaatgggtggccttcatttggtacgacggctccaacaagtactacgccgactccgtgaaggaccggttcaccatctcccgggacaactccaagaacaccctgtacctgcagatgaagtccctgcgggccgaggacaccgccgtgtactactgtgccagaagggccggcatcatcggcaccatcggctactactacggcatggacgtgtggggccagggcaccaccgtgaccgtgtctagc

SEQ ID NO: 2200 - protein, 125 aa, artificial; identical to SEQ ID NO: 543
  VH of CDH19 65254.003

SEQ ID NO: 2201 - DNA, 321 bp, artificial; identical to SEQ ID NO: 2188
  VL of CDH19 65254.003

SEQ ID NO: 2202 - protein, 107 aa, artificial; identical to SEQ ID NO: 2189
  VL of CDH19 65254.003

SEQ ID NO: 2203 - DNA, 741 bp, artificial
  VH-VL of CDH19 65254.003
caggtgcagctggtggaatccggcggaggcgtggtgcagcctggcgggtccctgagactgtcttgcgccgcctccggcttcaccttctccagctacggcatgcactgggtccgacaggcccctggcaagggcctggaatgggtggccttcatttggtacgacggctccaacaagtactacgccgactccgtgaaggaccggttcaccatctcccgggacaactccaagaacaccctgtacctgcagatgaagtccctgcgggccgaggacaccgccgtgtactactgtgccagaagggccggcatcatcggcaccatcggctactactacggcatggacgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaagtacaccagttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggactcctccaccgtggtgttcggcggaggcaccaagctgaccgtgctgtcc

SEQ ID NO: 2204 - protein, 247 aa, artificial
  VH-VL of CDH19 65254.003
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWDSSTVVFGGGTKLTVLS

SEQ ID NO: 2205 - protein, 507 aa, artificial
  CDH19 65254.003 x I2C
QVQLVESGGGVVQPGGSLRLSCAASGFTFSSYGMHWVRQAPGKGLEWVAFIWYDGSNKYYADSVKDRFTISRDNSKNTLYLQMKSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWDSSTVVFGGGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 2206 - protein, 5 aa, artificial
  CDR-H1 of CDH19 65254.007
SYGMH

SEQ ID NO: 2207 - protein, 17 aa, artificial
  CDR-H2 of CDH19 65254.007
FIWYEGSNKYYAESVKD

SEQ ID NO: 2208 - protein, 16 aa, artificial
  CDR-H3 of CDH19 65254.007
RAGIIGTIGYYYGMDV

SEQ ID NO: 2209 - protein, 11 aa, artificial
  CDR-L1 of CDH19 65254.007
SGDRLGEKYTS

SEQ ID NO: 2210 - protein, 7 aa, artificial
  CDR-L2 of CDH19 65254.007
QDTKRPS

SEQ ID NO: 2211 - protein, 9 aa, artificial
  CDR-L3 of CDH19 65254.007
QAWESSTVV

SEQ ID NO: 2212 - DNA, 375 bp, artificial
  VH of CDH19 65254.007
caggtgcagctggtggaatccggcggaggcgtggtgcagcctggcgggtccctgagactgtcttgcgccgcctccggcttcaccttctccagctacggcatgcactgggtccgacaggcccctggcaagggcctggaatgggtggccttcatttggtacgagggctccaacaagtactacgccgagtccgtgaaggaccggttcaccatctcccgggacaactccaagaacaccctgtacctgcagatgaattccctgcgggccgaggacaccgccgtgtactactgtgccagaagggccggcatcatcggcaccatcggctactactacggcatggacgtgtggggccagggcaccaccgtgaccgtgtctagc

SEQ ID NO: 2213 - protein, 125 aa, artificial; identical to SEQ ID NO: 475
  VH of CDH19 65254.007

SEQ ID NO: 2214 - DNA, 321 bp, artificial
  VL of CDH19 65254.007
tcttacgagctgacccagcccccctccgtgtccgtgtctcctggccagaccgcctccatcacctgttctggcgaccggctgggcgagaagtacaccagttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggagtcctccaccgtggtgttcggcggaggcaccaagctgaccgtgctgtcc

SEQ ID NO: 2215 - protein, 107 aa, artificial
  VL of CDH19 65254.007
SYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLS

SEQ ID NO: 2216 - DNA, 741 bp, artificial
  VH-VL of CDH19 65254.007
caggtgcagctggtggaatccggcggaggcgtggtgcagcctggcgggtccctgagactgtcttgcgccgcctccggcttcaccttctccagctacggcatgcactgggtccgacaggcccctggcaagggcctggaatgggtggccttcatttggtacgagggctccaacaagtactacgccgagtccgtgaaggaccggttcaccatctcccgggacaactccaagaacaccctgtacctgcagatgaattccctgcgggccgaggacaccgccgtgtactactgtgccagaagggccggcatcatcggcaccatcggctactactacggcatggacgtgtggggccagggcaccaccgtgaccgtgtctagcggaggcggaggatctggtggcggtggttctggcggcggaggctcctcttacgagctgacccagcccccctccgtgtccgtgtctcctggccagaccgcctccatcacctgttctggcgaccggctgggcgagaagtacaccagttggtatcagcagcggcctggccagtcccccctgctggtcatctaccaggacaccaagcggccctccggcatccctgagcggttctccggctccaactccggcaacaccgccaccctgaccatctccggcacccaggccatggacgaggccgactactactgccaggcctgggagtcctccaccgtggtgttcggcggaggcaccaagctgaccgtgctgtcc

SEQ ID NO: 2217 - protein, 247 aa, artificial
  VH-VL of CDH19 65254.007
QVQLVESGGGVVQPGGSLRLSCAASGFTFSSYGMHWVRQAPGKGLEWVAFIWYEGSNKYYAESVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGGGTKLTVLS

SEQ ID NO: 2218 - protein, 507 aa, artificial; identical to SEQ ID NO: 1190
  CDH19 65254.007 x I2C

SEQ ID NO: 2219 - protein, 549 aa, artificial
  CDH19 14302 CC x I2C-LFcBY
QRFVTGHFGGLYPANGGGGGSQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGHHHHHH

SEQ ID NO: 2220 - protein, 574 aa, artificial
  CDH19 14302 CC x I2C-LFcBY-156
QRFVTGHFGGLYPANGGGGGSQVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGGGGSQRFCTGHFGGLHPCNGGGGGSGGGSRDWDFDVFGGGTPVGGHHHHHH

SEQ ID NO: 2221 - protein, 514 aa, artificial
  CDH19 14302 CC x I2C-Cys-Loop
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLGCGGGGCHHHHHH

SEQ ID NO: 2222 - protein, 1100 aa, artificial
  CDH19 14302 CC x I2C-HALB
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLDYHHHHHH

SEQ ID NO: 2223 - protein, 717 aa, artificial
  CDH19 14302 CC x I2C-GS-D3HSA
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2224 - protein, 727 aa, artificial
  CDH19 14302 CC x I2C-3GS-D3HSA
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLHHHHHH

SEQ ID NO: 2225 - protein, 742 aa, artificial
  CDH19 14302 CC x I2C-GS-D3HSA-156
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRDWDFDVFGGGTPVGGHHHHHH

SEQ ID NO: 2226 - protein, 752 aa, artificial
  CDH19 14302 CC x I2C-3GS-D3HSA-156
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRDWDFDVFGGGTPVGGHHHHHH

SEQ ID NO: 2227 - protein, 744 aa, artificial
  CDH19 14302 CC x I2C-GS-D3HSA-21
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRLIEDICLPRWGCLWEDDHHHHHH

SEQ ID NO: 2228 - protein, 754 aa, artificial
  CDH19 14302 CC x I2C-3GS-D3HSA-21
QVQLVESGGGVVQPGGSLRLSCAASGFTFSSYGMHWVRQAPGKCLEWVAFIWYDGSNKYYADSVKDRFTISRDNSKNTLYLQMNSLRAEDTAVYYCARRAGIIGTIGYYYGMDVWGQGTTVTVSSGGGGSGGGGSGGGGSSYELTQPPSVSVSPGQTASITCSGDRLGEKYTSWYQQRPGQSPLLVIYQDTKRPSGIPERFSGSNSGNTATLTISGTQAMDEADYYCQAWESSTVVFGCGTKLTVLSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLPGGGGSGGGGSGGGGSEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGLGGGGSGGGSRLIEDICLPRWGCLWEDDHHHHHH

The invention claimed is:

1. An isolated multispecific antibody construct or an oligomer thereof comprising a first binding domain which binds to human CDH19 on the surface of a target cell and a second binding domain which binds to human CD3 on the surface of a T cell, wherein the first binding domain comprises a VH region comprising CDR-H1, CDR-H2 and CDR-H3 and a VL region comprising CDR-L1, CDR-L2 and CDR-L3 selected from the group consisting of:

(a) CDR-H1 comprising the amino acid sequence of SEQ ID NO: 94, CDR-H2 comprising the amino acid sequence of SEQ ID NO: 95, CDR-H3 comprising the amino acid sequence of SEQ ID NO: 96, CDR-L1 comprising the amino acid sequence of SEQ ID NO: 262, CDR-L2 comprising the amino acid sequence of SEQ ID NO: 263 and CDR-L3 comprising the amino acid sequence of SEQ ID NO: 264;

(b) CDR-H1 comprising the amino acid sequence of SEQ ID NO: 100, CDR-H2 comprising the amino acid sequence of SEQ ID NO: 101, CDR-H3 comprising the amino acid sequence of SEQ ID NO: 102, CDR-L1 comprising the amino acid sequence of SEQ ID NO: 268, CDR-L2 comprising the amino acid sequence of SEQ ID NO: 269 and CDR-L3 comprising the amino acid sequence of SEQ ID NO: 270;

(c) CDR-H1 comprising the amino acid sequence of SEQ ID NO: 118, CDR-H2 comprising the amino acid sequence of SEQ ID NO: 119, CDR-H3 comprising the amino acid sequence of SEQ ID NO: 120, CDR-L1 comprising the amino acid sequence of SEQ ID NO: 286, CDR-L2 comprising the amino acid sequence of SEQ ID NO: 287 and CDR-L3 comprising the amino acid sequence of SEQ ID NO: 288;

(d) CDR-H1 comprising the amino acid sequence of SEQ ID NO: 154, CDR-H2 comprising the amino acid sequence of SEQ ID NO: 155, CDR-H3 comprising the amino acid sequence of SEQ ID NO: 156, CDR-L1 comprising the amino acid sequence of SEQ ID NO: 322, CDR-L2 comprising the amino acid sequence of SEQ ID NO: 323 and CDR-L3 comprising the amino acid sequence of SEQ ID NO: 324;

(e) CDR-H1 comprising the amino acid sequence of SEQ ID NO: 100, CDR-H2 comprising the amino acid sequence of SEQ ID NO: 101, CDR-H3 comprising the amino acid sequence of SEQ ID NO: 912, CDR-L1 comprising the amino acid sequence of SEQ ID NO: 268, CDR-L2 comprising the amino acid sequence of SEQ ID NO: 269 and CDR-L3 comprising the amino acid sequence of SEQ ID NO: 270;

(f) CDR-H1 comprising the amino acid sequence of SEQ ID NO: 100, CDR-H2 comprising the amino acid sequence of SEQ ID NO: 101, CDR-H3 comprising the amino acid sequence of SEQ ID NO: 913, CDR-L1 comprising the amino acid sequence of SEQ ID NO: 268, CDR-L2 comprising the amino acid sequence of SEQ ID NO: 269 and CDR-L3 comprising the amino acid sequence of SEQ ID NO: 270;

(g) CDR-H1 comprising the amino acid sequence of SEQ ID NO: 94, CDR-H2 comprising the amino acid sequence of SEQ ID NO: 95, CDR-H3 comprising the amino acid sequence of SEQ ID NO: 910, CDR-L1 comprising the amino acid sequence of SEQ ID NO: 262, CDR-L2 comprising the amino acid sequence of SEQ ID NO: 263 and CDR-L3 comprising the amino acid sequence of SEQ ID NO: 264;

(h) CDR-H1 comprising the amino acid sequence of SEQ ID NO: 94, CDR-H2 comprising the amino acid sequence of SEQ ID NO: 95, CDR-H3 comprising the amino acid sequence of SEQ ID NO: 911, CDR-L1 comprising the amino acid sequence of SEQ ID NO: 262, CDR-L2 comprising the amino acid sequence of SEQ ID NO: 263 and CDR-L3 comprising the amino acid sequence of SEQ ID NO: 264;

(i) CDR-H1 comprising the amino acid sequence of SEQ ID NO: 118, CDR-H2 comprising the amino acid sequence of SEQ ID NO: 119, CDR-H3 comprising the amino acid sequence of SEQ ID NO: 120, CDR-L1 comprising the amino acid sequence of SEQ ID NO: 286, CDR-L2 comprising the amino acid sequence of SEQ ID NO: 287 and CDR-L3 comprising the amino acid sequence of SEQ ID NO: 288;

(j) CDR-H1 comprising the amino acid sequence of SEQ ID NO: 118, CDR-H2 comprising the amino acid sequence of SEQ ID NO: 914, CDR-H3 comprising the amino acid sequence of SEQ ID NO: 120, CDR-L1 comprising the amino acid sequence of SEQ ID NO: 286, CDR-L2 comprising the amino acid sequence of SEQ ID NO: 287 and CDR-L3 comprising the amino acid sequence of SEQ ID NO: 288;

(k) CDR-H1 comprising the amino acid sequence of SEQ ID NO: 154, CDR-H2 comprising the amino acid sequence of SEQ ID NO: 155, CDR-H3 comprising the amino acid sequence of SEQ ID NO: 920, CDR-L1 comprising the amino acid sequence of SEQ ID NO: 322, CDR-L2 comprising the amino acid sequence of SEQ ID NO: 323 and CDR-L3 comprising the amino acid sequence of SEQ ID NO: 324;

(l) CDR-H1 comprising the amino acid sequence of SEQ ID NO: 996, CDR-H2 comprising the amino acid sequence of SEQ ID NO: 997, CDR-H3 comprising the amino acid sequence of SEQ ID NO: 998, CDR-L1 comprising the amino acid sequence of SEQ ID NO: 999, CDR-L2 comprising the amino acid sequence of SEQ ID NO: 1000 and CDR-L3 comprising the amino acid sequence of SEQ ID NO: 1001;

(m) CDR-H1 comprising the amino acid sequence of SEQ ID NO: 1048, CDR-H2 comprising the amino acid sequence of SEQ ID NO: 1049, CDR-H3 comprising the amino acid sequence of SEQ ID NO: 1050, CDR-L1 comprising the amino acid sequence of SEQ ID NO: 1051, CDR-L2 comprising the amino acid sequence of SEQ ID NO: 1052 and CDR-L3 comprising the amino acid sequence of SEQ ID NO: 1053;

(n) CDR-H1 comprising the amino acid sequence of SEQ ID NO: 1087, CDR-H2 comprising the amino acid sequence of SEQ ID NO: 1088, CDR-H3 comprising the amino acid sequence of SEQ ID NO: 1089, CDR-L1 comprising the amino acid sequence of SEQ ID NO: 1090, CDR-L2 comprising the amino acid sequence of SEQ ID NO: 1091 and CDR-L3 comprising the amino acid sequence of SEQ ID NO: 1092;

(o) CDR-H1 comprising the amino acid sequence of SEQ ID NO: 1608, CDR-H2 comprising the amino acid sequence of SEQ ID NO: 1609, CDR-H3 comprising the amino acid sequence of SEQ ID NO: 1610, CDR-L1 comprising the amino acid sequence of SEQ ID NO: 1611, CDR-L2 comprising the amino acid sequence of SEQ ID NO: 1612 and CDR-L3 comprising the amino acid sequence of SEQ ID NO: 1613;

(p) CDR-H1 comprising the amino acid sequence of SEQ ID NO: 1621, CDR-H2 comprising the amino acid sequence of SEQ ID NO: 1622, CDR-H3 comprising the amino acid sequence of SEQ ID NO: 1623, CDR-L1 comprising the amino acid sequence of SEQ ID NO: 1624, CDR-L2 comprising the amino acid sequence of SEQ ID NO: 1625 and CDR-L3 comprising the amino acid sequence of SEQ ID NO: 1626;

(q) CDR-H1 comprising the amino acid sequence of SEQ ID NO: 1634, CDR-H2 comprising the amino acid sequence of SEQ ID NO: 1635, CDR-H3 comprising the amino acid sequence of SEQ ID NO: 1636, CDR-L1 comprising the amino acid sequence of SEQ ID NO: 1637, CDR-L2 comprising the amino acid sequence of SEQ ID NO: 1638 and CDR-L3 comprising the amino acid sequence of SEQ ID NO: 1639;

(r) CDR-H1 comprising the amino acid sequence of SEQ ID NO: 1673, CDR-H2 comprising the amino acid sequence of SEQ ID NO: 1674, CDR-H3 comprising the amino acid sequence of SEQ ID NO: 1675, CDR-L1 comprising the amino acid sequence of SEQ ID NO: 1676, CDR-L2 comprising the amino acid sequence of SEQ ID NO: 1677 and CDR-L3 comprising the amino acid sequence of SEQ ID NO: 1678;

(s) CDR-H1 comprising the amino acid sequence of SEQ ID NO: 1686, CDR-H2 comprising the amino acid sequence of SEQ ID NO: 1687, CDR-H3 comprising the amino acid sequence of SEQ ID NO: 1688, CDR-L1 comprising the amino acid sequence of SEQ ID NO: 1689, CDR-L2 comprising the amino acid sequence of SEQ ID NO: 1690 and CDR-L3 comprising the amino acid sequence of SEQ ID NO: 1691;

(t) CDR-H1 comprising the amino acid sequence of SEQ ID NO: 1699, CDR-H2 comprising the amino acid sequence of SEQ ID NO: 1700, CDR-H3 comprising the amino acid sequence of SEQ ID NO: 1701, CDR-L1 comprising the amino acid sequence of SEQ ID NO: 1702, CDR-L2 comprising the amino acid sequence of SEQ ID NO: 1703 and CDR-L3 comprising the amino acid sequence of SEQ ID NO: 1704;

(u) CDR-H1 comprising the amino acid sequence of SEQ ID NO: 1712, CDR-H2 comprising the amino acid sequence of SEQ ID NO: 1713, CDR-H3 comprising the amino acid sequence of SEQ ID NO: 1714, CDR-L1 comprising the amino acid sequence of SEQ ID NO: 1715, CDR-L2 comprising the amino acid sequence of SEQ ID NO: 1716 and CDR-L3 comprising the amino acid sequence of SEQ ID NO: 1717;

(v) CDR-H1 comprising the amino acid sequence of SEQ ID NO: 1725, CDR-H2 comprising the amino acid sequence of SEQ ID NO: 1726, CDR-H3 comprising the amino acid sequence of SEQ ID NO: 1727, CDR-L1 comprising the amino acid sequence of SEQ ID NO: 1728, CDR-L2 comprising the amino acid sequence of SEQ ID NO: 1729 and CDR-L3 comprising the amino acid sequence of SEQ ID NO: 1730;

(w) CDR-H1 comprising the amino acid sequence of SEQ ID NO: 1738, CDR-H2 comprising the amino acid sequence of SEQ ID NO: 1739, CDR-H3 comprising the amino acid sequence of SEQ ID NO: 1740, CDR-L1 comprising the amino acid sequence of SEQ ID NO: 1741, CDR-L2 comprising the amino acid sequence of SEQ ID NO: 1742 and CDR-L3 comprising the amino acid sequence of SEQ ID NO: 1743;

(x) CDR-H1 comprising the amino acid sequence of SEQ ID NO: 1751, CDR-H2 comprising the amino acid sequence of SEQ ID NO: 1752, CDR-H3 comprising the amino acid sequence of SEQ ID NO: 1753, CDR-L1 comprising the amino acid sequence of SEQ ID NO: 1754, CDR-L2 comprising the amino acid sequence of SEQ ID NO: 1755 and CDR-L3 comprising the amino acid sequence of SEQ ID NO: 1756;

(y) CDR-H1 comprising the amino acid sequence of SEQ ID NO: 1764, CDR-H2 comprising the amino acid sequence of SEQ ID NO: 1765, CDR-H3 comprising the amino acid sequence of SEQ ID NO: 1766, CDR-L1 comprising the amino acid sequence of SEQ ID NO: 1767, CDR-L2 comprising the amino acid sequence of SEQ ID NO: 1768 and CDR-L3 comprising the amino acid sequence of SEQ ID NO: 1769; and (z) CDR-H1 comprising the amino acid sequence of SEQ ID NO: 1920, CDR-H2 comprising the amino acid sequence of SEQ ID NO: 1921, CDR-H3 comprising the amino acid sequence of SEQ ID NO: 1922, CDR-L1 comprising the amino acid sequence of SEQ ID NO: 1923, CDR-L2 comprising the amino acid sequence of SEQ ID NO: 1924 and CDR-L3 comprising the amino acid sequence of SEQ ID NO: 1925.

2. The antibody construct or the oligomer thereof according to claim 1, wherein the first binding domain comprises a VH region comprising the amino acid sequence of SEQ ID NO: 338, SEQ ID NO: 354, SEQ ID NO: 378, SEQ ID NO: 356, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, SEQ ID NO: 501, SEQ ID NO: 502, SEQ ID NO: 503, SEQ ID NO: 504, SEQ ID NO: 505, SEQ ID NO: 506, SEQ ID NO: 517, SEQ ID NO: 518, SEQ ID NO: 1003, SEQ ID NO: 1055, SEQ ID NO: 1094, SEQ ID NO: 1615, SEQ ID NO: 1628, SEQ ID NO: 1641, SEQ ID NO: 1680, SEQ ID NO: 1693, SEQ ID NO: 1706, SEQ ID NO: 1719, SEQ ID NO: 1732, SEQ ID NO: 1745, SEQ ID NO: 1758, SEQ ID NO: 1771, or SEQ ID NO: 1927.

3. The antibody construct or the oligomer thereof according to claim 1, wherein the first binding domain comprises a VL region comprising the amino acid sequence of SEQ ID NO: 394, SEQ ID NO: 410, SEQ ID NO: 434, SEQ ID NO: 412, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 596, SEQ ID NO: 597, SEQ ID NO: 598, SEQ ID NO: 599, SEQ ID NO: 600, SEQ ID NO: 601, SEQ ID NO: 612, SEQ ID NO: 613, SEQ ID NO: 1005, SEQ ID NO: 1057, SEQ ID NO: 1096, SEQ ID NO: 1617, SEQ ID NO: 1630, SEQ ID NO: 1643, SEQ ID NO: 1682, SEQ ID NO: 1695, SEQ ID NO: 1708, SEQ ID NO: 1721, SEQ ID NO: 1734, SEQ ID NO: 1747, SEQ ID NO: 1760, SEQ ID NO: 1773, or SEQ ID NO: 1929.

4. The antibody construct or the oligomer thereof according to claim 1, wherein the first binding domain comprises a VH region and a VL region comprising the amino acid sequence of SEQ ID NOs: 338 and 394, SEQ ID NOs: 354 and 410, SEQ ID NOs: 378 and 434, SEQ ID NOs: 356 and 412, SEQ ID NOs: 476 and 571, SEQ ID NOs: 477 and 572, SEQ ID NOs: 478 and 573, SEQ ID NOs: 479 and 574, SEQ ID NOs: 480 and 575, SEQ ID NOs: 481 and 576, SEQ ID NOs: 482 and 577, SEQ ID NOs: 483 and 578, SEQ ID NOs: 484 and 579, SEQ ID NOs: 501 and 596, SEQ ID NOs: 502 and 597, SEQ ID NOs: 503 and 598, SEQ ID NOs: 504 and 599, SEQ ID NOs: 505 and 600, SEQ ID NOs: 506 and 601, SEQ ID NOs: 517 and 612, SEQ ID NOs: 518 and 613, SEQ ID NOs: 1003 and 1005, SEQ ID NOs: 1055 and 1057, SEQ ID NOs: 1094 and 1096, SEQ ID NOs: 1615 and 1617, SEQ ID NOs: 1628 and 1630, SEQ ID NOs: 1641 and 1643, SEQ ID NOs: 1680 and 1682, SEQ ID NOs: 1693 and 1695, SEQ ID NOs: 1706 and 1708, SEQ ID NOs: 1719 and 1721, SEQ ID NOs: 1732 and 1734, SEQ ID NOs: 1745 and 1747, SEQ ID NOs: 1758 and 1760, SEQ ID NOs: 1771 and 1773, or SEQ ID NOs: 1927 and 1929.

5. The antibody construct or the oligomer thereof according to claim 1, wherein the antibody construct or the oligomer thereof is in a format selected from the group consisting of a single chain bispecific antibody (scFv)$_2$, a scFv-single domain mAb, and a diabody.

6. The antibody construct or the oligomer thereof according to claim 5, wherein the first binding domain comprises an amino acid sequence comprising the amino acid sequence of SEQ ID NO: 1007, SEQ ID NO: 1059, SEQ ID NO: 1098, SEQ ID NO: 1619, SEQ ID NO: 1632, SEQ ID NO: 1645, SEQ ID NO: 1684, SEQ ID NO: 1697, SEQ ID NO: 1710, SEQ ID NO: 1723, SEQ ID NO: 1736, SEQ ID NO: 1749, SEQ ID NO: 1762, SEQ ID NO: 1775, or SEQ ID NO: 1931.

7. The antibody construct or the oligomer thereof according to claim 1, wherein the second binding domain binds to human CD3 epsilon and to any of Callithrix jacchus, Saguinus oedipus or Saimiri sciureus CD3 epsilon.

8. The antibody construct or the oligomer thereof according claim 7, comprising the amino acid sequence comprising the amino acid sequence of SEQ ID NO: 1008, SEQ ID NO: 1060, SEQ ID NO: 1099, SEQ ID NO: 1620, SEQ ID NO: 1633, SEQ ID NO: 1646, SEQ ID NO: 1685, SEQ ID NO: 1698, SEQ ID NO: 1711, SEQ ID NO: 1724, SEQ ID NO: 1737, SEQ ID NO: 1750, SEQ ID NO: 1763, SEQ ID NO: 1776, or SEQ ID NO: 1932 .

9. A composition comprising the antibody construct or the oligomer thereof of claim 1 and a carrier, stabilizer and/or excipient.

10. A kit comprising the antibody construct or the oligomer thereof of claim 1 and
(a) a container for housing the antibody construct or the oligomer thereof, or
(b) a syringe for delivering the antibody construct or the oligomer thereof, or
(c) a combination of (a) and (b).

11. A nucleic acid encoding the antibody construct or the oligomer thereof of claim 1.

12. A vector comprising the nucleic acid of claim 11.

13. An isolated host cell transformed or transfected with the nucleic acid of claim 11.

14. A process for the production of an antibody construct or an oligomer thereof, said process comprising culturing the host cell of claim 13 under conditions allowing the expression of the antibody construct or the oligomer thereof.

15. A method for treating or ameliorating a melanoma disease, comprising the step of administering to a subject in need thereof an effective amount of the antibody construct or the oligomer thereof of claim 1.

16. The method according to claim 15, wherein the melanoma disease is selected from the group consisting of superficial spreading melanoma, lentigo maligna, lentigo maligna melanoma, acral lentiginous melanoma and nodular melanoma.

17. The method of claim 15, wherein the melanoma disease is a metastatic melanoma disease.

* * * * *